US009089539B2

(12) United States Patent
DiMarchi et al.

(10) Patent No.: US 9,089,539 B2
(45) Date of Patent: Jul. 28, 2015

(54) ESTER-BASED INSULIN PRODRUGS

(71) Applicant: Indiana University Research and Technology Corporation, Indianapolis, IN (US)

(72) Inventors: Richard D. DiMarchi, Carmel, IN (US); Arnab De, Bloomington, IN (US)

(73) Assignee: Indiana University Research and Technology Corporation, Indianapolis, IN (US)

( * ) Notice: Subject to any disclaimer, the term of this patent is extended or adjusted under 35 U.S.C. 154(b) by 0 days.

(21) Appl. No.: 14/182,706

(22) Filed: Feb. 18, 2014

(65) Prior Publication Data
US 2014/0212419 A1    Jul. 31, 2014

Related U.S. Application Data

(60) Division of application No. 12/845,455, filed on Jul. 28, 2010, now Pat. No. 8,697,838, which is a continuation of application No. PCT/US2009/031593, filed on Jan. 21, 2009.

(60) Provisional application No. 61/024,672, filed on Jan. 30, 2008.

(51) Int. Cl.
| A61K 38/00 | (2006.01) |
| C07K 14/62 | (2006.01) |
| A61K 38/28 | (2006.01) |
| A61K 9/00 | (2006.01) |
| A61K 38/26 | (2006.01) |
| A61K 47/48 | (2006.01) |
| A61K 39/395 | (2006.01) |

(52) U.S. Cl.
CPC .............. *A61K 38/28* (2013.01); *A61K 9/0019* (2013.01); *A61K 38/26* (2013.01); *A61K 39/395* (2013.01); *A61K 47/48215* (2013.01); *A61K 47/48246* (2013.01)

(58) Field of Classification Search
None
See application file for complete search history.

(56) References Cited

U.S. PATENT DOCUMENTS

| 3,740,385 | A |   | 6/1973 | Ondetti |
| 4,275,152 | A |   | 6/1981 | Esders et al. |
| 4,741,897 | A |   | 5/1988 | Andrews et al. |
| 4,876,242 | A |   | 10/1989 | Applebaum et al. |
| 4,985,407 | A |   | 1/1991 | Foxton et al. |
| 5,028,586 | A | * | 7/1991 | Balschmidt et al. ........... 514/6.2 |
| 5,359,030 | A |   | 10/1994 | Ekwuribe |
| 5,514,646 | A |   | 5/1996 | Chance et al. |
| 5,545,618 | A |   | 8/1996 | Buckley et al. |
| 5,759,818 | A |   | 6/1998 | Boime |
| 5,843,634 | A |   | 12/1998 | Brate et al. |
| 6,180,767 | B1 |   | 1/2001 | Wickstrom et al. |
| 6,197,926 | B1 |   | 3/2001 | Gaur et al. |
| 6,476,290 | B1 |   | 11/2002 | Wright et al. |
| 6,630,348 | B1 |   | 10/2003 | Lee et al. |
| 6,746,853 | B1 |   | 6/2004 | Dahiyat et al. |
| 7,045,337 | B2 |   | 5/2006 | Schultz et al. |
| 7,326,688 | B2 |   | 2/2008 | O'Harte |
| 7,521,422 | B2 |   | 4/2009 | Bernard |
| 8,263,545 | B2 |   | 9/2012 | Levy et al. |
| 8,697,838 | B2 | * | 4/2014 | Dimarchi et al. ............. 530/303 |
| 2002/0038026 | A1 |   | 3/2002 | Rao et al. |
| 2002/0160938 | A1 |   | 10/2002 | Brandenburg et al. |
| 2002/0184489 | A1 |   | 12/2002 | Mraz |
| 2003/0195147 | A1 |   | 10/2003 | Pillutla et al. |
| 2003/0204063 | A1 |   | 10/2003 | Gravel et al. |
| 2004/0054130 | A1 |   | 3/2004 | Ng et al. |
| 2004/0121940 | A1 |   | 6/2004 | DeGroot et al. |
| 2005/0014679 | A1 |   | 1/2005 | Beals et al. |
| 2005/0125574 | A1 |   | 6/2005 | Foster et al. |
| 2005/0187147 | A1 |   | 8/2005 | Newman et al. |
| 2006/0171920 | A1 |   | 8/2006 | Shechter et al. |
| 2006/0210534 | A1 |   | 9/2006 | Lee et al. |
| 2006/0223753 | A1 |   | 10/2006 | Glass |
| 2007/0129284 | A1 |   | 6/2007 | Kjeldsen et al. |
| 2007/0173452 | A1 |   | 7/2007 | DiMarchi et al. |
| 2007/0203058 | A1 |   | 8/2007 | Lau et al. |
| 2007/0224119 | A1 |   | 9/2007 | McTavish |
| 2008/0113411 | A1 |   | 5/2008 | Sheffer |
| 2008/0113905 | A1 |   | 5/2008 | DiMarchi et al. |

(Continued)

FOREIGN PATENT DOCUMENTS

| CN | 1341122 | 3/2002 |
| CN | 1511044 | 7/2004 |

(Continued)

OTHER PUBLICATIONS

"Peptides: Frontiers of Peptide Science," Proceedings of the Fifteenth American Peptide Symposium, Jun. 14-19, 1997, Nashville, Tennessee, USA; ed. James P. Tam and Praven T.P. Kaumaya.
De et al., Synthesis and characterization of ester-based prodrugs of glucagon-like peptide 1, *Biopolymers*, 94(4): 448-56 (2010).
Harris, J. Milton, Final Word: PEGylation—A "Sunset" Technology? <http://licence.icopyright.net/user/viewFreeUse.
act?fuid=OTU1NjY3OA%3D%3D>, BioPharm International, Jun. 1, 2004.
M.J. Roberts et al., "Chemistry for Peptide and Protein PEGylation," Advance Drug Delivery Reviews, Elsevier BV, Amsterdam, NL, vol. 54, No. 4, Jun. 17, 2002, pp. 459-476.
De, A. and DiMarchi, R. Synthesis & Analysis of Peptide Hormone-based prodrugs, (2009) Proceedings of the 21st American Peptide Society 160-161.

(Continued)

*Primary Examiner* — James H Alstrum Acevedo
*Assistant Examiner* — Jeanette Lieb
(74) *Attorney, Agent, or Firm* — Barnes & Thornburg LLP

(57) ABSTRACT

Prodrug formulations of bioactive polypeptides are provided wherein the bioactive polypeptide has been modified by the linkage of a dipeptide to the bioactive polypeptide through an ester linkage. The prodrugs disclosed herein in some embodiments have extended half lives of at least 1.5 hours (e.g., at least 10 hours), and more typically greater than 20 hours and less than 70 hours, and are converted to the active form at physiological conditions through a non-enzymatic reaction driven by chemical instability.

12 Claims, 20 Drawing Sheets

(56) References Cited

U.S. PATENT DOCUMENTS

| | | |
|---|---|---|
| 2008/0214648 A1 | 9/2008 | De Kock et al. |
| 2009/0054305 A1 | 2/2009 | Schlein et al. |
| 2009/0176964 A1 | 7/2009 | Walensky et al. |
| 2009/0186817 A1 | 7/2009 | Ghosh et al. |
| 2009/0192072 A1 | 7/2009 | Pillutla et al. |
| 2009/0209453 A1 | 8/2009 | Moyle |
| 2009/0221037 A1 | 9/2009 | Lee et al. |
| 2010/0081614 A1 | 4/2010 | Fares et al. |
| 2010/0190701 A1 | 7/2010 | Day et al. |
| 2011/0065633 A1 | 3/2011 | DiMarchi et al. |
| 2011/0257091 A1 | 10/2011 | DiMarchi |
| 2011/0288003 A1 | 11/2011 | DiMarchi et al. |
| 2012/0010134 A1 | 1/2012 | Zion et al. |

FOREIGN PATENT DOCUMENTS

| | | |
|---|---|---|
| CN | 1635900 | 7/2005 |
| CN | 1867360 | 11/2006 |
| EP | 0220958 | 5/1987 |
| EP | 741188 | 11/1996 |
| EP | 1161452 | 2/2000 |
| EP | 2036539 A1 | 3/2009 |
| EP | 2036923 A1 | 3/2009 |
| JP | 2003/192698 | 7/2003 |
| WO | 90/12814 | 11/1990 |
| WO | 93/03174 | 2/1993 |
| WO | 96/34882 | 11/1996 |
| WO | 98/11126 | 3/1998 |
| WO | 99/46283 | 9/1999 |
| WO | 9967278 | 12/1999 |
| WO | 00/50456 | 8/2000 |
| WO | 02/10195 | 2/2002 |
| WO | 03/079972 | 10/2003 |
| WO | 2004/067548 | 8/2004 |
| WO | 2004/078777 | 9/2004 |
| WO | 2005/054291 | 6/2005 |
| WO | 2005/025554 | 7/2005 |
| WO | 2006/047214 | 5/2006 |
| WO | 2006/097521 | 9/2006 |
| WO | 2006/009902 | 12/2006 |
| WO | 2007/096332 | 8/2007 |
| WO | 2007030577 | 10/2007 |
| WO | 2008/019368 | 2/2008 |
| WO | 2008/021560 | 2/2008 |
| WO | 2008/025528 | 3/2008 |
| WO | 2008055488 | 5/2008 |
| WO | 2008/081418 | 7/2008 |
| WO | 2008/101017 | 8/2008 |
| WO | WO2009034118 A1 | 3/2009 |
| WO | WO2009034119 A1 | 3/2009 |
| WO | 2009/067636 | 5/2009 |
| WO | 2009/095479 | 8/2009 |
| WO | 2009/099763 | 8/2009 |
| WO | 2010/011313 | 1/2010 |
| WO | 2010/071807 | 6/2010 |
| WO | 2010/080605 | 7/2010 |
| WO | 2010/080609 | 7/2010 |
| WO | 2011/159895 | 12/2011 |
| WO | 2011/163012 | 12/2011 |
| WO | 2011/163460 | 12/2011 |
| WO | 2011/163462 | 12/2011 |

OTHER PUBLICATIONS

Battersby et al., "Diketopiperazine Formation and N-Terminal Degradation in Recombinant Human Growth Hormone", *International Journal of Peptide & Protein Research* 44: 215-222, (1994) (Abstract).

Eriksson et al., "hPEPT1 Affinity and Translocation of Selected Gln-Sar and Glu-Sar Dipeptide Derivatives", *Molecular Pharmaceutics* vol. 2, No. 3: 242-249 (May 10, 2005).

Garcia-Aparicio et al., "Design and Discovery of a Novel Dipeptidyl-peptidase IV (CD26)-Based Prodrug Approach", *J. Med. Chem.* 49: 5339-5351 (2006).

Goolcharran et al., "Comparison of the Rates of Deamidation, Diketopiperazine Formation, and Oxidation in Recombinant Human Vascular Endothelial Growth Factor and Model Peptides", *AAPS Pharmsci* 2000 2(1) article 5: 1-6 (Mar. 17, 2000).

Santos et al., Cyclization-Activated Prodrugs. Synthesis, Reactivity and Toxicity of Dipeptide Esters of Paracetamol, *Bioorganic & Medicinal Chemistry Letters* 15: 1595-1598 (2005).

Sato, H., "Enzymatic procedure for site-specific pegylation of proteins," Advanced Drug Delivery Reviews 54, pp. 487-504 (2002).

Ward, "Fatty Acid Acylation of Peptides: Developing strategies to enhance medicines for treating metabolic disorders," Jan. 14, 2009.

DiMarchi, "Peptides—Development of Prodrug Chemistry," RBF Symposium Feb. 1-4, 2011 India.

Yang et al., "A Novel Approach to Resin-Based Cysteine Alkylation," American Peptide Society, 2005.

PCT International Search Report for PCT/US2009/068745 completed by the US Searching Authority on Feb. 1, 2010.

PCT International Search Report for PCT/US2009/031593 completed by the US Searching Authority on Jul. 16, 2009.

Schuttler, A. and D. Brandenburg, Preparation and Properties of Covalently Linked Insulin Dimers. Hoppe-Seylers Zeitschrift Fur Physiologische Chemie, 1982. 363(3): p. 317-330.

Tatnell, M.A., et al., Evidence Concerning the Mechanism of Insulin-Receptor Interaction and the Structure of the Insulin-Receptor from Biological Properties of Covalently Linked Insulin Dimers. Biochemical Journal, 1983. 216(3): p. 687-694.

Roth, R.A., et al., Effects of Covalently Linked Insulin Dimers on Receptor Kinase-Activity and Receptor down Regulation. Febs Letters, 1984. 170(2): p. 360-364.

Tatnell, M.A., R.H. Jones, and P.H. Sonksen, Covalently-Linked Insulin Dimers—Their Metabolism and Biological Effects Invivo as Partial Competitive Antagonists of Insulin-Clearance. Diabetologia, 1984. 27(1): p. 27-31.

Joost, H.G., et al., Quantitative Dissociation of Glucose-Transport Stimulation and Insulin-Receptor Tyrosine Kinase Activation in Isolated Adipocytes with a Covalent Insulin Dimer (B29,B29'-Sunberoyl-Insulin). Biochemical Pharmacology, 1989. 38(14): p. 2269-2277.

Breiner, M., et al., Heterogeneity of Insulin-Receptors in Rat-Tissues as Detected with the Partial Agonist B29,B29'-Suberoyl-Insulin. Molecular Pharmacology, 1993. 44(2): p. 271-276.

Deppe, C., et al., Structure-Activity Relationship of Covalently Dimerized Insulin Derivatives—Correlation of Partial Agonist Efficacy with Cross-Linkage at Lysine B29. Naunyn-Schmiedebergs Archives of Pharmacology, 1994. 350(2): p. 213-217.

Shojaee-Moradie, F., et al., Demonstration of a Relatively Hepatoselective Effect of Covalent Insulin Dimers on Glucose-Metabolism in Dogs. Diabetologia, 1995. 38(9): p. 1007-1013.

Du X et al, Hydroxyl group of insulin A19Tyris essential for receptor binding: studies on (A9Phe) insulin, BioChem and Mol Biology International, Academic Press, Lindon, GB vol. 45, No. 2, Jun 1, 1998, pp. 255-260. found in extended EP search report 09837982.9.

PCT International Search Report for PCT/US2009/068716 completed by the US Searching Authority on May 3, 2010.

European supplemental search report for EP 09837983.7 completed by the EPO on Mar. 15, 2012.

Cheng et al., "The Development of an Insulin-based Prodrug," APS poster presentation, May 12, 2011.

Coffman et al., "Insulin-metal ion interactions: the binding of divalent cations to insulin hexamers and tetramers and the assembly of insulin-hexamers," Biochemistry, Aug. 9, 1988, vol. 27, No. 16, pp. 6179-6187.

De, Design of peptide-based prodrug chemistry and its application to glucagon-like peptide 1. Masters Thesis Aug. 2007. [Retrieved from the Internet on Jun. 16, 2009: <https://scholarworksiu.edu/dspace/browse?value=De%2C+ArnabBtype=author>]; p. 8, para 2; p. 16, para 3; p. 40, para.1; p. 66, para 2; p. 77, para 1-2; p. 79, para 1.

De, et al., "Investigation of the feasibily of an amide-based prodrug under physiological conditions," Int. J. Pept. Res. Ther., 14, pp. 255-262 (2008).

Du et al., "Biochemistry and Molecular Biology International," vol. 45, No. 2, Jun. 1, 1998, pp. 255-260 XP008147747.

GenBank entry AAH05278, Jul. 15, 2006 [http:www/ncbi.nlm.nih.gov/protein/13528972>].

(56) References Cited

OTHER PUBLICATIONS

Han et al., "IGF-based Insulin Analogs with an A-Chain Lactam," APS poster presentation, May 12, 2011.

Kaur et al., "Novel Single Chain Insulin Analogs Consisting of a Non-Peptide Based Connection," APS poster presentation, May 12, 2011.

Han et al., "Structure-Activity Relationship of Insulin at Position $A^{19}$," APS poster presentation, Jun. 7, 2009.

Han et al., "Insulin Chemical Synthesis Using a Two-Step Orthogonal Formation of the Disulfides," APS poster presentation, Jun. 7, 2009.

Kaur et al., "Chemical Synthesis of Insulin and Related Analogs," APS poster presentation, Jun. 7, 2009.

Kristensen et al., "Alanine Scanning Mutagenesis of Insulin," The Journal of Biological Chemistry, 1997, 272(20):12978-12983.

Madsen et al., "Structure—Activity and Protraction Relationship of Long-Acting Glucagon-like Peptide-1 Derivatives: Importance of Fatty acid Length, Polarity, and Bulkiness," J. Med. Chem. 2007, 50, pp. 6126-6132.

Mayer et al., Insulin Structure and Function, Peptide Science 2007, 88(5):687-713.

Mroz, Piotr et al., "Bioactivity of Insulin Analogs with Altered B-Chain Secondary Structure," APS poster presentation, Jun. 7, 2009.

O'Brien, Assay for DPPIV Activity using a Homogenous, Luminescent Method, Cell Notes, 2005, 11:8-11 (http://www.promega.com/resources/articles/pubhub/cellnotes/assay-for-dppiv-activity-using-a-homogeneous-luminescent-method/).

PCT International Search Report for PCT/US2009/068711 completed by the US Searching Authority on Feb. 4, 2010.

PCT International Search Report for PCT/US2009/068712 completed by the US Searching Authority on Mar. 24, 2010.

PCT International Search Report for PCT/US2009/068713.

PCT International Search Report for PCT/US2011/041601 completed by the US Searching Authority on Nov. 10, 2011.

Phillips et al., "Supramolecular protein engineering: design of zinc-stapled insulin hexamers as a long acting depot," J. Biol. Chem., Apr. 16, 2010, vol. 285, No. 16, pp. 11755-11759.

Schilling et al., "Degradation of Insulin by Trypsin and Alphachymotrypsin," Pharmaceutical Research 1991, 8(6):721-727 (abstract).

Quan et al., "Coordinated Interaction of the Insulin B-chain Helical Domain with the aromatic Active Site," APS poster presentation, Jun. 7, 2009.

Wang et al., "Identification of Site(s) of Insulin Nitration by Peroxynitrite and Characterization of its Structural Change," Protein & Peptide Letters 2008, 15:1063-1067.

Zhao et al., "Improved Pharmacokinetics through Site-Specific PEGylation of Insulin Analogs," APS poster presentation, May 12, 2011.

Gershonov et al, A Novel Approach for a Watter-Soluble long Acting Insulin Prodrug . . . , J. Med. Chem (2000) vol. 43, pp. 2530-2537.

Evans et al., "Effect of Î-Endorphin C-Terminal Peptides on Glucose Uptake in Isolated Skeletal Muscles of the Mouse", Peptides, vol. 18, No. 1, pp. 165-167, (1997).

Kurapkat et al "Inactive conformation of an insulin despite its wild-type sequence", Protein Science, vol. 6, No. 3, pp. 580-587 (Mar. 1997).

Hamel et al "Cyclosporin a prodrugs: Design, systhesis and biophysical properties", J. Peptide Research, vol. 63 No. 2 pp. 147-154 (Feb. 2004).

Coy et al, J of Medicinal Chemistry, 1973, vol. 16, No. 7, 827-829.

Yang et al, "Relationship between insulin A chain regions and insulin biological activities," World J. of Gastroentero, 2000: 6(3): 371-373 (Jun. 2000).

Hinds et al, Advancec Drug Delivery Reviews 2002, (54) 505-530 (Jun. 17, 2002).

Hua et al, J of Bilogical Chemistry, Mar. 2008, vol. 283, No. 21, 14703-14716 (May 23, 2008).

Weiland et al, "Antagonistic effects of a covalently dimerized insulin derivatized insulin derivative on insulin receptors in 3T3-L1 adipocytes", PNAS, vol. 87, pp. 1154-1158, Feb. 1990.

Cloutier, et al, "Low-energy (3-24eV) electron damage to the peptide backbone" J Phys Chem B. 111(7), p. 1620-1624 (Feb. 22, 2007).

G. Rajpal et al, "Single Chain Insulins as Receptor Agonists", Molecular Endocrinology, vol. 23, No. 5, Feb. 19, 2009 p. 679-688.

Suaifan et al, "Effects of steric bulk and stereochemistry on the rates of diketopiperazine formation from N-aminoacyl-2,2-dimethylthiazolidine-4-carboxamides (Dmt dipeptide amides)—a model for a new prodrug linker system," Tetrahedron 62, pp. 11245-11266, (Nov. 2006).

Shechter et al , "Reversible pegylation of insulin facilitates its prolonged action in vitro", Eur. J. Pharm. and Biopharm. 70 (Apr. 7, 2008) p. 19-28.

Hiroshi Ogawa et al "N-Methylation of sleeted peptide bonds on the biological activity of insulin", International J of Peptide and Protein Research, vol. 30, No. 4, p. 460-473 (Oct. 1987).

Shechter et al , "Albumin-insulin conjugate releasing insulin slowly under physiogiacal conditions: a new concept for long-acting insulin", Bioconjugate Chemistry vol. 16, No. 4, p. 913-920 (Jul.-Aug. 2005).

Worrall et al "Synthesis of an organoinsulin molecule tha tcan be activated by antibody catalysis", PNAS vol. 98, No. 24, p. 13514-13518 (Nov. 20, 2001).

Zhou et al., "Peptide and protein drugs: I. Therapeutic applications, absorption and parenteral administration," International Journal of Pharmaceutics vol. 75 p. 97-111 (Sep. 20, 1991).

\* cited by examiner

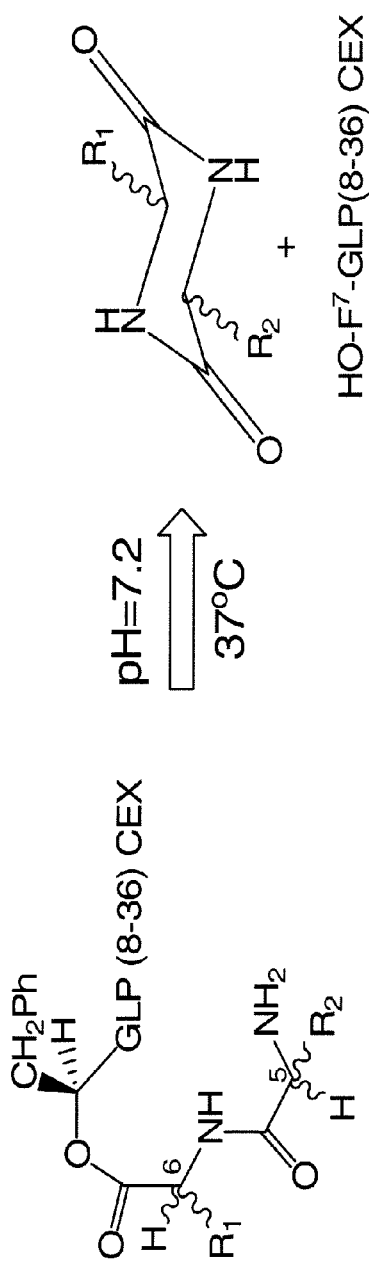
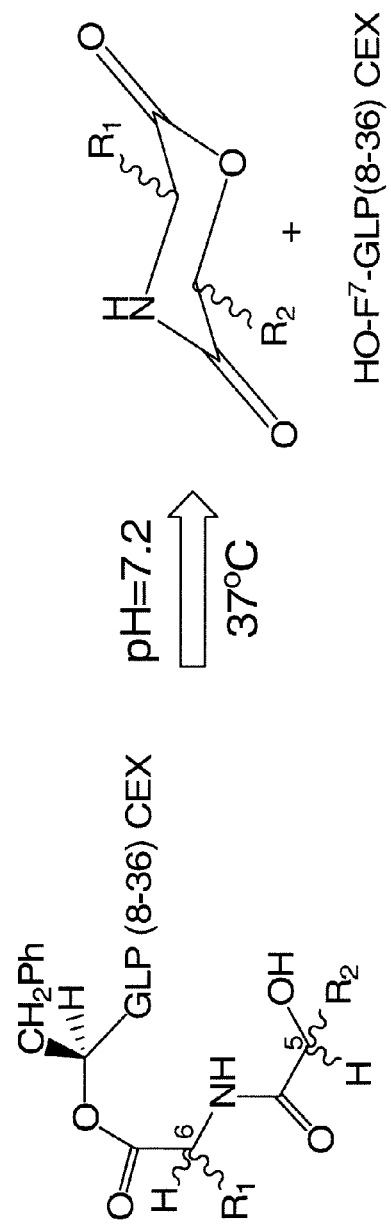
Fig. 5A
Fig. 5B

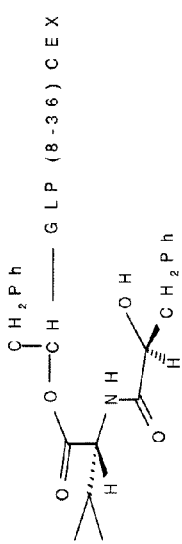
Fig. 6A  HO-F⁵dV⁶-O-F⁷,GLP(8-36)CEX ($t_{1/2}$ = 50.5 hr)
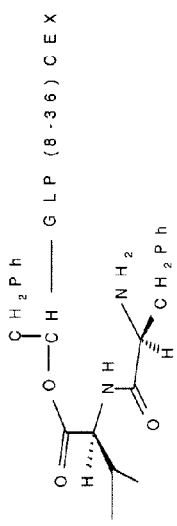
Fig. 6B  F⁵V⁶-O-F⁷,GLP(8-36)CEX ($t_{1/2}$ = 64 hrs)
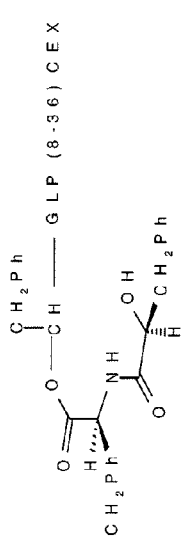
Fig. 6C  HO-F⁵F⁶-O-F⁷,GLP(8-36)CEX ($t_{1/2}$ = 33.3 hr)
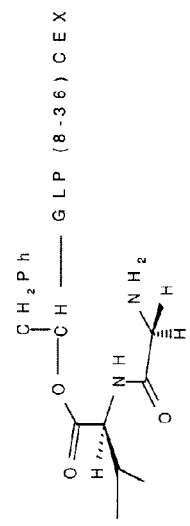
Fig. 6D  G⁵V⁶-O-F⁷,GLP(8-36)CEX ($t_{1/2}$ = 20.3 hr)

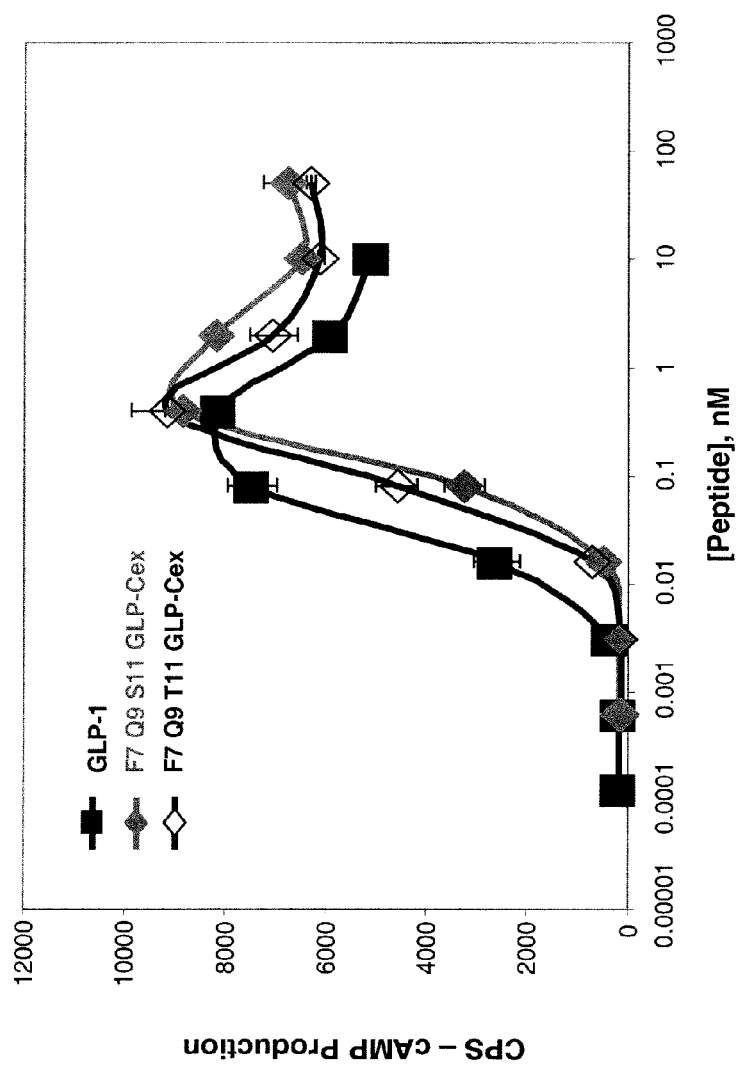

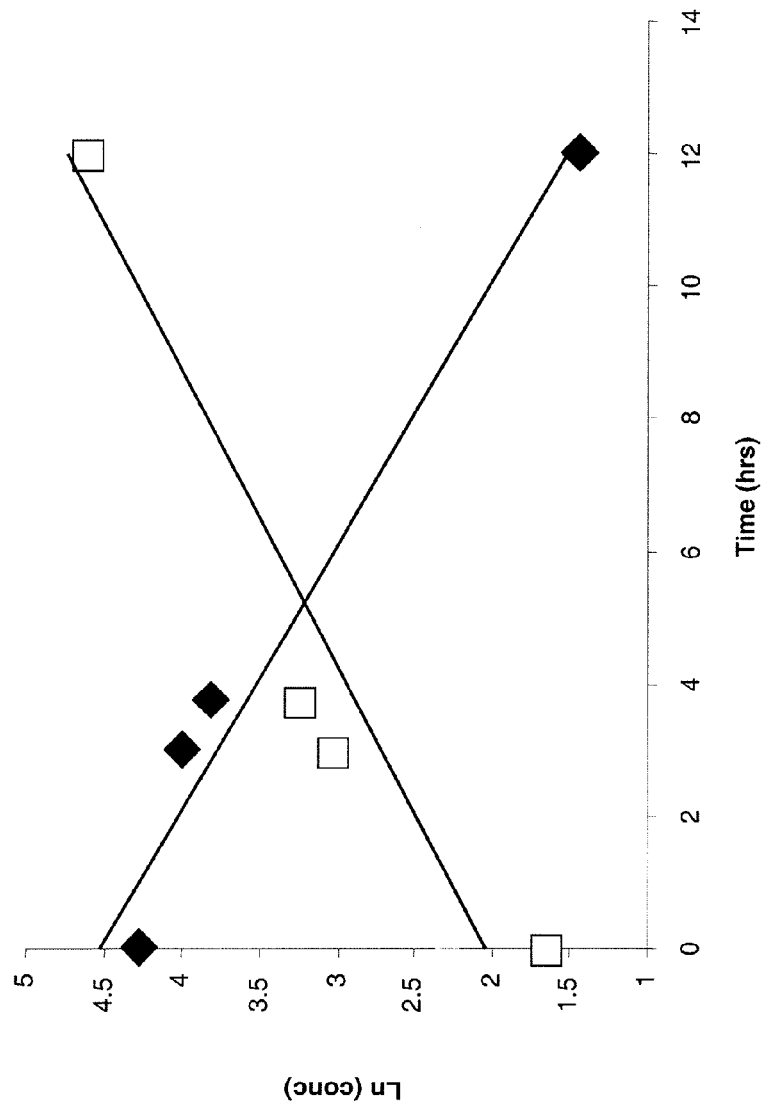

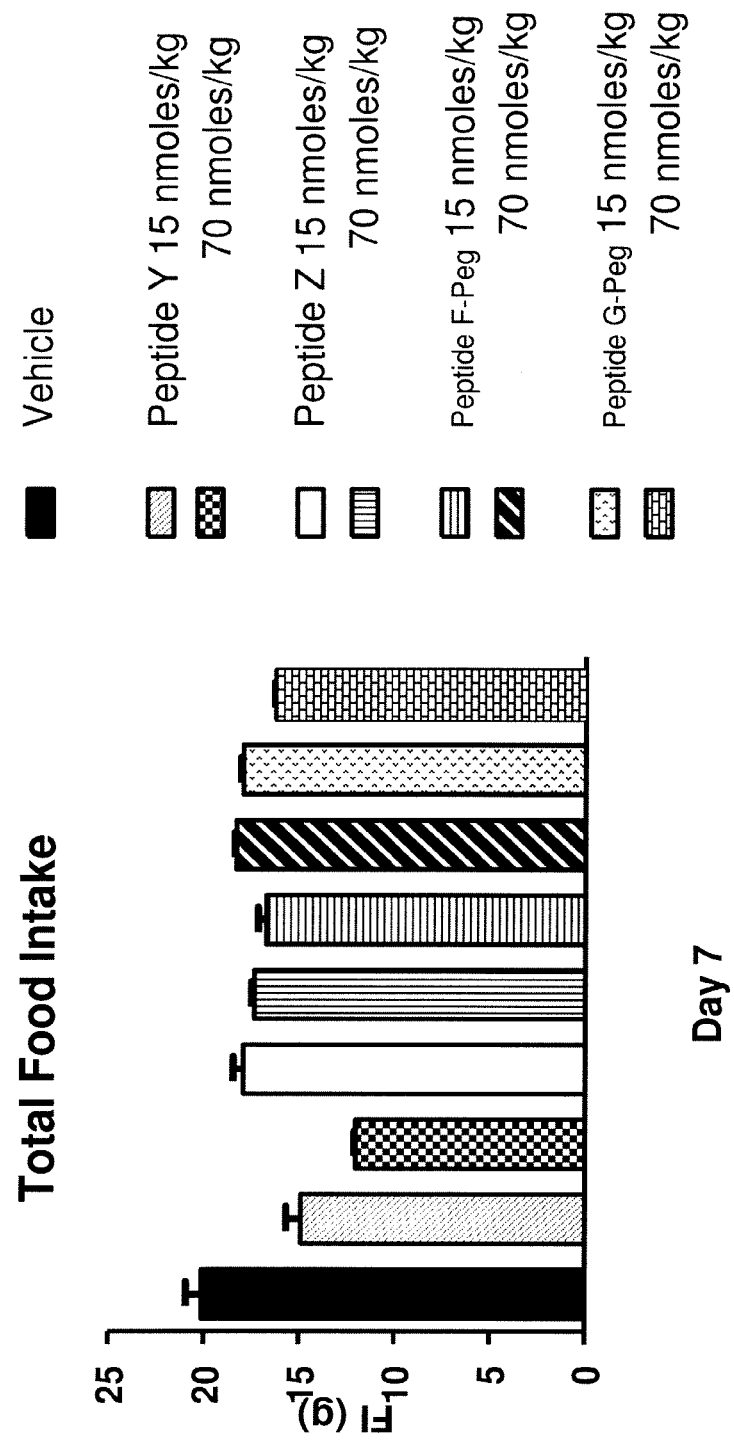

Figure 18

| Peptide Name | Sequence of Max. Identity | Sequence Length | SEQ ID NO: |
|---|---|---|---|
| GHRH | YADAIFTNSYRKVLGQLSARKLLQDIMSR------------- | 29 | 657 |
| PHM | HADGVFTSDFSKLLGQLSAKKYLESLM--------------- | 27 | 660 |
| VIP | HSDAVFTDNYTRLRKQMAVKKYLNSILN-------------- | 28 | 658 |
| PACAP-27 | HSDGIFTDSYSRYRKQMAVKKYLAAVL--------------- | 27 | 659 |
| Exendin-4 | HGEGTFTSDLSKQMEEEAVRLFIEWLKNGGPSSGAPPPS--- | 39 | 662 |
| GLP-1 | HAEGTFTSDVSSYLEGQAAKEFIAWLVKGRG----------- | 31 | 601 |
| Glucagon | HSQGTFTSDYSKYLDSRRAQDFVQWLMNT------------- | 29 | 612 |
| Oxyntomodulin | HSQGTFTSDYSKYLDSRRAQDFVQWLMDTKRNRNNIA----- | 37 | 665 |
| GIP | YAEGTFISDYSIAMDKIHQQDFVNWLLAQKGKKNDWKHNITQ | 42 | 664 |
| GLP-2 | HADGSFSDEMNTILDNLAARDFINWLIQTKITD--------- | 33 | 663 |
| Secretin | HSDGTFTSELSRLREGARLQRLLQGLV--------------- | 27 | 661 |

ESTER-BASED INSULIN PRODRUGS

CROSS REFERENCE TO RELATED APPLICATIONS

This application is a divisional of U.S. patent application Ser. No. 12/845,455, filed Jul. 28, 2010, which is a continuation application of international application serial No. PCT/US2009/031593 filed Jan. 21, 2009, which claims priority to U.S. Provisional Patent Application No. 61/024,672, filed Jan. 30, 2008. The entire disclosures of PCT/US2009/031593 and U.S. Ser. No. 61/024,672 are hereby incorporated by reference.

INCORPORATION OF SEQUENCE LISTING

The sequence listing with file name 229004SubSeqListing2.txt created on Apr. 7, 2014 (490 KB) is expressly incorporated by reference in its entirety.

BACKGROUND

Peptide-based drugs are highly effective medicines with relatively short duration of action and variable therapeutic index. The present disclosure is directed to peptide-based prodrugs wherein the prodrug derivative is designed to delay onset of action and extend the half life of the drug. The delayed onset of action is advantageous in that it allows systemic distribution of the prodrug prior to its activation. Accordingly, the administration of prodrugs eliminates complications caused by peak activities upon administration and increases the therapeutic index of the parent drug.

Receptor recognition and subsequent processing of the peptide and protein agonists is the primary route of degradation of many peptide and protein-based drugs. Thus binding of the peptide drug to its receptor will result in biological stimulation, but will also initiate the subsequent deactivation of the peptide/protein induced pharmacology through the enzymatic degradation of the peptide or protein. In accordance with the present disclosure, prodrugs can be prepared to extend the peptide or protein's biological half life based on a strategy of inhibiting recognition of the prodrug by the corresponding receptor.

The prodrugs disclosed herein will ultimately be chemically converted to structures that can be recognized by the receptor, wherein the speed of this chemical conversion will determine the time of onset and duration of in vivo biological action. The molecular design disclosed in this application relies upon an intramolecular chemical reaction that is not dependent upon additional chemical additives, or enzymes. The prodrug chemistry is broadly applicable to peptide and protein based drugs where an aliphatic hydroxyl group can be accommodated in the active site and when the chemically modified derivative yields a poorly active peptide or protein. A specific example to illustrate this point would be the formation of reversible serine esters, at the active site serine, in the family of serine proteases.

Insulin is a miraculous peptide hormone. It demonstrates unparalleled ability to lower glucose in virtually all forms of diabetes. Unfortunately, its pharmacology is not glucose sensitive and as such it is capable of excessive action that can lead to life-threatening hypoglycemia. Inconsistent pharmacology is a hallmark of insulin therapy such that it is extremely difficult to normalize blood glucose without occurrence of hypoglycemia. Furthermore, native insulin is of short duration of action and requires modification to render it suitable for use in control of basal glucose. Established approaches to delay the onset of insulin action include reduction in solubility, and albumin binding. Prodrug chemistry offers the opportunity to precisely control the onset and duration of insulin action after clearance from the site of administration and equilibration in the plasma at a highly defined concentration.

The rich history of studies detailing the insulin structure-function relationship directs the amino acid locations where prodrug chemistry can be successfully employed. Insulin is a two chain heterodimer that is biosynthetically derived from a low potency single chain proinsulin precursor through enzymatic processing. Human insulin is comprised of two peptide chains (an "A chain" (SEQ ID NO: 613) and "B chain" (SEQ ID NO: 614)) bound together by disulfide bonds and having a total of 51 amino acids. The C-terminal region of the B-chain and two terminal ends of the A-chain associate in three-dimensional structure to assembly a site for high affinity binding to the insulin receptor. The selective insertion of hydroxyl groups can be accommodated without loss in potency at multiple locations within this active site region. Chemical esterification of these active site hydroxyl groups with specific dipeptides would dramatically lessen activity and serve as suitable prodrugs.

Pre-proglucagon is a 158 amino acid precursor polypeptide that is processed in different tissues to form a number of different proglucagon-derived peptides, including glucagon, glucagon-like peptide-1 (GLP-1), glucagon-like peptide-2 (GLP-2) and oxyntomodulin (OXM), that are involved in a wide variety of physiological functions, including glucose homeostasis, insulin secretion, gastric emptying, and intestinal growth, as well as the regulation of food intake. Glucagon is a 29-amino acid peptide (SEQ ID NO: 612 that corresponds to amino acids 33 through 61 of pre-proglucagon, while GLP-1 is produced as a 37-amino acid peptide that corresponds to amino acids 72 through 108 of pre-proglucagon. GLP-1(7-36) amide (SEQ ID NO: 602; the C terminus is an arginine amide) or GLP-1(7-37) acid (SEQ ID NO: 601; C terminus is a glycine) are biologically potent forms of GLP-1, that demonstrate essentially equivalent activity at the GLP-1 receptor.

Glucagon is a life-saving medicine that is used in the acute treatment of severe hypoglycemia. Oxyntomodulin has been reported to have pharmacological ability to suppress appetite and lower body weight. Clinical studies with GLP-1 like agonists have proven this family of peptides to be an effective treatment for Type II diabetes. In addition, it might be intrinsically safer than insulin therapy because of its glucose dependent action, thus eliminating the chances of hypoglycemia. Structure-activity relationship studies have shown that the N terminal histidine for each of these three peptides (glucagon, GLP-1 and oxyntomodulin) is especially important for the full action and that N-terminally extended forms severely diminish biological potency.

One disadvantage associated with the therapeutic use of these three peptides is their extremely short half-life (approximately two minutes) in plasma. Accordingly, to obtain reasonable glycemic control, native glucagon related analog peptides would need to be administered continuously for a prolonged period of time. The short half life results from the rapid degradation by Dipeptidyl Peptidase IV (DPP-IV), which cleaves between the second and third amino acids. This cleavage not only inactivates the native peptides but in the case of glucagon and GLP-1 the shortened forms are functional antagonists at their respective receptors. Accordingly, there is a need for longer-acting variants of glucagon, GLP-1, and oxyntomodulin, and related peptides, to realize the full therapeutic potential of these mechanisms of drug action.

SUMMARY

In accordance with one embodiment a prodrug derivative of a bioactive polypeptide is prepared by covalently linking a dipeptide to the bioactive polypeptide via an ester linkage. In one embodiment the dipeptide is covalently bound to the bioactive polypeptide at a position that interferes with the bioactive polypeptide's ability to interact with its corresponding receptor or cofactor. Subsequent removal of the dipeptide, under physiological conditions and in the absence of enzymatic activity, restores full activity to the polypeptide.

In accordance with one embodiment a prodrug is provided comprising the general structure of Formula I:

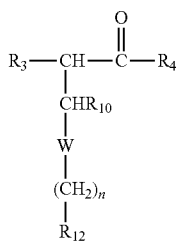

I wherein $R_3$ is selected from the group consisting of $NH_2$, an amino acid sequence and

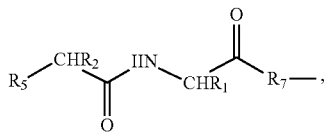

$R_4$ is —OH, $NH_2$ or an amino acid sequence, $R_{10}$ is selected from the group consisting of H, $C_1$-$C_4$ alkyl, and $(CH_2)_n(C_6$-$C_{10}$ aryl), W is $C_6$-$C_{10}$ aryl or a bond, and n is an integer from 0 to 3.

$R_1$ and $R_2$ are independently selected from the group consisting of H, $C_1$-$C_4$ alkyl, $(C_1$-$C_4$ alkyl)OH, $(C_1$-$C_4$ alkyl)SH, $(C_2$-$C_3$ alkyl)SCH$_3$, $(C_1$-$C_4$ alkyl)CONH$_2$, $(C_1$-$C_4$ alkyl)COOH, $(C_1$-$C_4$ alkyl)NH$_2$, $(C_1$-$C_4$ alkyl)NHC(NH$_2^+$) NH$_2$, $(C_4$-$C_6$)cycloalkyl, $(C_0$-$C_4$ alkyl)$(C_6$-$C_{10}$ aryl)$R_9$, and $CH_2$ $(C_5$-$C_9$ heteroaryl), $R_5$ is OH or $NH_2$, and $R_9$=$C_1$-$C_4$ alkyl, $NH_2$, or OH, wherein $R_7$ is —O-amino acid or O, and $R_{12}$ is —OH, H or

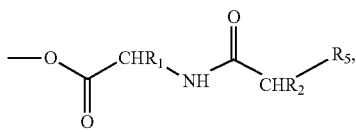

with the proviso that $R_3$ is not

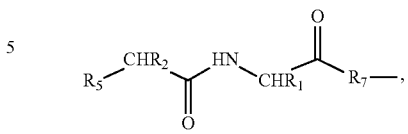

when $R_{12}$ is

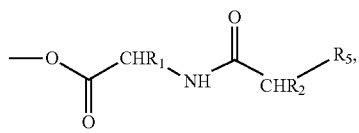

and with the further proviso that $R_{12}$ is

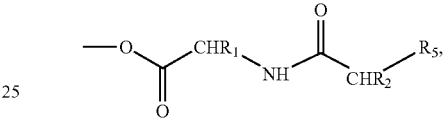

when $R_3$ is $NH_2$ or an amino acid sequence.

In some embodiments, $R_3$ or $R_4$ is an amino acid sequence of a bioactive peptide. In more specific embodiments, $R_3$ is an amino acid sequence of the bioactive peptide which is N-terminal to an amino acid of the bioactive peptide comprising a side chain of structure

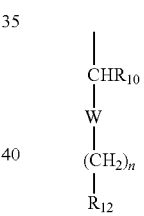

and $R_4$ is an amino acid sequence of the bioactive peptide which is C-terminal to the amino acid of the bioactive peptide.

In some embodiments, when $R_3$ is

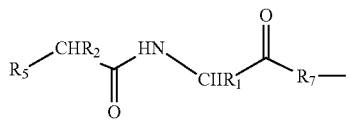

and $R_7$ is O-amino acid, $R_7$ is an amino acid sequence of the bioactive peptide which is N-terminal to an amino acid of the bioactive peptide comprising a side chain of structure

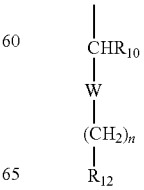

and $R_4$ is an amino acid sequence of the bioactive peptide which is C-terminal to the amino acid of the bioactive peptide.

In one embodiment $R_3$ is

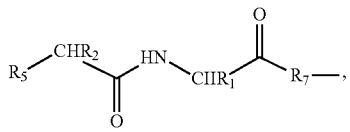

and $R_7$ and $R_4$ represent amino acid sequences from glucagon, GLP-1 or insulin peptides.

In an alternative embodiment $R_3$ is an N-terminal sequence selected from either glucagon, GLP-1 or insulin peptides, $R_4$ is a carboxy terminal sequence selected from either glucagon, GLP-1 or insulin peptides and $R_{12}$ is

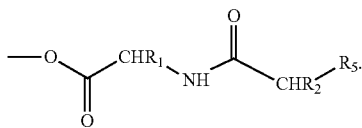

In accordance with one embodiment a prodrug derivative of a bioactive protein is provided comprising the general structure of Formula II:

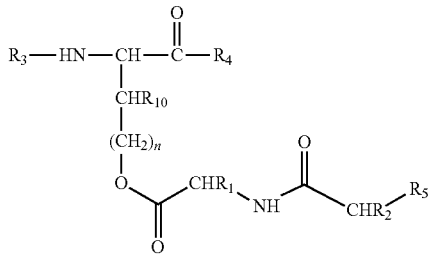

wherein $R_3$ is H or the N-terminal amino acids of the bioactive protein (e.g., a glucagon, GLP-1 or insulin peptide), $R_4$ represents OH or the C-terminal amino acids of the bioactive protein (e.g., a glucagon, GLP-1 or insulin peptide), $R_{10}$ is selected from the group consisting of H, $C_1$-$C_4$ alkyl, and $(CH_2)_n(C_6$-$C_{10}$ aryl), and n is an integer from 0 to 3.

$R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$) NH$_2$, ($C_4$-$C_6$)cycloalkyl, ($C_0$-$C_4$ alkyl)($C_6$-$C_{10}$ aryl)$R_9$, and CH$_2$ ($C_5$-$C_9$ heteroaryl), wherein $R_5$ is OH or NH$_2$ and $R_9$=$C_1$-$C_4$ alkyl, NH$_2$ or OH. In one embodiment $R_1$ is selected from the group consisting of CH(CH$_3$)$_2$, CH$_2$CH(CH$_3$)$_2$, CH(CH$_3$) (CH$_2$CH$_3$), ($C_4$-$C_5$)cycloalkyl, ($C_0$-$C_4$ alkyl)($C_6$ aryl), and ($C_0$-$C_4$ alkyl)($C_5$-$C_6$ heteroaryl), $R_2$ is selected from the group consisting of ($C_0$-$C_4$ alkyl)$C_1$-$C_4$ alkyl, ($C_4$-$C_5$)cycloalkyl, ($C_0$-$C_4$ alkyl)($C_6$ aryl), and ($C_0$-$C_4$ alkyl)($C_5$-$C_6$ heteroaryl), and $R_5$ is OH or NH$_2$.

In one embodiment the dipeptide is linked to the bioactive polypeptide through the hydroxyl group of a serine or threonine residue (i.e., n is 0 and $R_{10}$ is H, or n is 0 and $R_{10}$ is CH$_3$ in the compound of Formula II). More particularly, the modified serine or threonine residue is located in a protein binding domain or active site, such that attachment of the dipeptide interferes with the bioactive polypeptide's ability to interact with its native receptor or substrate.

With regard to the prodrugs of general structure of Formula II, at least one of $R_3$ or $R_4$ represent amino acids of the bioactive peptide. In some embodiments, $R_3$ and $R_4$ represent amino acids of the bioactive peptide.

In accordance with some embodiments, the prodrug comprises a general structure of A-B-Q, wherein A is a hydroxyl acid or amino acid covalently linked to B; B is an amino acid covalently linked to Q via an ester bond, and Q is a bioactive peptide, polypeptide, or protein, e.g., a glucagon superfamily peptide (e.g., a glucagon related analog peptide), wherein the chemical cleavage half-life ($t_{1/2}$) of A-B from Q is no more than about 1 week in PBS under physiological conditions.

In accordance with one embodiment a non-enzymatic self cleaving complex comprising the general structure A-B-Q is provided, wherein Q is a known bioactive peptide and A-B represents a dipeptide. More particularly, A can be either an amino acid or a hydroxyl acid, and B is an amino acid. The dipeptide (A-B) is covalently bound to Q via an ester linkage at a position that interferes with Q's ability to interact with its corresponding receptor or cofactor. In one embodiment Q is a bioactive peptide, polypeptide, or protein, e.g., a glucagon superfamily peptide such as a glucagon related analog peptide and A-B represents a dipeptide of the structure:

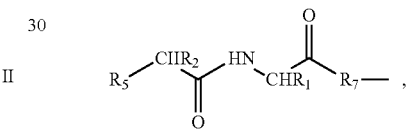

wherein $R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl) COOH, ($C_1$-$C_4$ alkyl)NH$_2$, ($C_1$-$C_4$ alkyl)NHC(NH$_2$) NH$_2$, ($C_4$-$C_6$)cycloalkyl, ($C_0$-$C_4$ alkyl)($C_6$-$C_{10}$ aryl)$R_9$, and CH$_2$ ($C_5$-$C_9$ heteroaryl), $R_5$ is OH or NH$_2$, and
$R_9$=$C_1$-$C_4$ alkyl, NH$_2$, or OH, and
wherein $R_7$ is —O-amino acid or O.

In one embodiment an injectable depot composition is provided comprising a complex having the general structure of A-B-Q wherein A is an amino acid or a hydroxyl acid;

B is an amino acid covalently linked to Q via an ester bond, and Q is a bioactive peptide, polypeptide, or protein, e.g., a glucagon superfamily peptide such as a glucagon related analog peptide, wherein the dipeptide A-B further comprises a depot polymer linked to the side chain of A or B. The depot polymer is selected to be of a sufficient size that the complex A-B-Q is effectively sequestered at the site of injection or is otherwise incapable of interacting with its target (e.g., receptor). Chemical cleavage of A-B from Q produces a diketopiperazine or diketomorpholine and releases the active bioactive peptide, polypeptide, or protein to the patient in a controlled manner over a predetermined duration of time after administration.

In accordance with one embodiment, the bioactive polypeptide is selected from the group consisting of insulin, glucagon and GLP-1 and derivatives of said polypeptides wherein the derivative polypeptide comprises 1 to 6 amino acid substitutions relative to the native sequence. The substituting amino acids can be either natural amino acids or synthetic amino acids, and in one embodiment the amino acid substitutions represent conservative amino acid substitutions.

In one embodiment the prodrug comprises the general structure of Formula III:

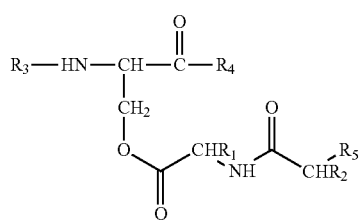

wherein $R_3$ comprises the N-terminal amino acids of a bioactive protein (e.g., a glucagon, GLP-1 or insulin peptide), $R_4$ comprises the C-terminal amino acids of the bioactive protein (e.g., a glucagon, GLP-1 or insulin peptide), $R_1$ and $R_2$ are independently selected from the group consisting of H, $C_1$-$C_3$ alkyl, $CH_2CH(CH_3)_2$, $CH(CH_3)(CH_2CH_3)$, $(C_4$-$C_5)$cycloalkyl, $CH_2(C_6$-$C_{10}$ aryl), and $CH_2(C_5$-$C_9$ heteroaryl), and $R_5$ is OH or $NH_2$ wherein the a non-enzymatic activation t½ is between 1-100 hrs, and more typically between 12 and 72 hours, and in one embodiment the t½ is between 24-48 hrs.

In one embodiment $R_1$ is selected from the group consisting of $CH_2(CH_3)_2$, $(C_4$-$C_5)$cycloalkyl, $CH_2(C_6$ aryl), and $CH_2(C_5$-$C_6$ heteroaryl), $R_2$ is selected from the group consisting of $(C_4$-$C_5)$cycloalkyl, $CH_2(C_6$ aryl) and $CH_2(C_5$-$C_6$ heteroaryl), and $R_5$ is OH or $NH_2$.

In some embodiments, wherein the prodrug comprises the general structure of Formula III, $R_3$ comprises the N-terminal amino acids of the bioactive protein which are N-terminal to an amino acid comprising a side chain structure

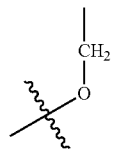

and R4 comprises the C-terminal amino acids of the bioactive protein which are C-terminal to the amino acid.

In some aspects, wherein the prodrug comprises the general structure of Formula I, II, or III, the bioactive peptide, bioactive polypeptide, or bioactive protein is selected from a group consisting of a glucagon superfamily peptide (e.g., glucagon related analog peptide), osteocalcin, insulin, and an analog, derivative, or conjugate of one of the foregoing.

In some aspects, the glucagon superfamily peptide is selected from the group consisting of Growth Hormone Releasing Hormone (GHRH; SEQ ID NO: 657), vasoactive intestinal peptide (VIP; SEQ ID NO: 658), Pituitary adenylate cyclase-activating polypeptide 27 (PACAP-27; SEQ ID NO: 659), peptide histidine methionine (PHM; SEQ ID NO: 660), or Secretin (SEQ ID NO: 661), glucagon (SEQ ID NO: 612), exendin-4 (SEQ ID NO: 662), Glucagon-like peptide-1 (GLP-1) (amino acids 7-37 provided as SEQ ID NO: 601), Glucagon-like peptide-2 (GLP-2) (SEQ ID NO: 663), GIP (SEQ ID NO: 664) or Oxyntomodulin (SEQ ID NO: 665), and an analog, derivative, or conjugate of one of the foregoing.

In some aspects, wherein the prodrug comprises the general structure of Formula I, II, or III, the glucagon superfamily peptide is a glucagon related analog peptide.

In accordance with one embodiment a prodrug derivative of insulin is provided wherein the insulin prodrug comprises an A chain comprising a sequence of SEQ ID NO: 626 and a B chain comprising a sequence of SEQ ID NO: 628 wherein a dipeptide of the formula

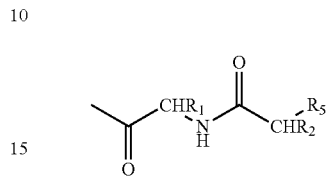

is linked via an ester bond to a side chain of an amino acid located at position 1, 4 or 21 of SEQ ID NO: 626 or at position 1, 5, 12 or 21 of SEQ ID NO: 628, wherein $R_1$ and $R_2$ are independently selected from the group consisting of H, $C_1$-$C_3$ alkyl, $CH_2CH(CH_3)_2$, $CH(CH_3)(CH_2CH_3)$, $(C_4$-$C_5)$cycloalkyl, $CH_2(C_6$-$C_{10}$ aryl), and $CH_2(C_5$-$C_9$ heteroaryl), and $R_5$ is OH or $NH_2$.

In accordance with one embodiment a prodrug derivative of GLP-1 or glucagon is provided wherein the prodrug comprises a polypeptide of the general structure of

wherein Y is a structure selected from the group consisting of

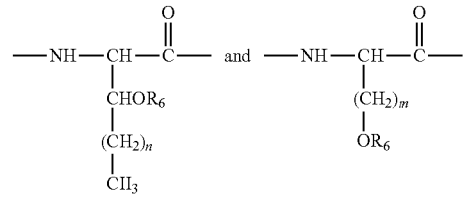

wherein n is an integer selected from 0 to 3 and m is an integer selected from 1-4, $R_3$ is an amino acid sequence selected from the group consisting of $X_1X_2X_3G$ (SEQ ID NO: 621) and

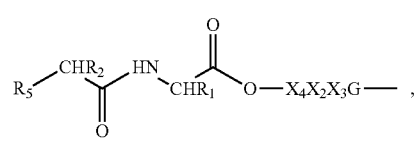

wherein $X_1$ is selected from the group consisting of histidine, hydroxy-histidine, homo-histidine, tyrosine and phenylalanine, $X_2$ is an amino acid selected from the group consisting of glycine, alanine, serine, valine, d alanine, aminoisobutyric acid, N-methyl alanine and similar sized natural and synthetic amino acids, $X_3$ is selected from the group consisting of glutamic acid, aspartic acid, glutamine and asparagine, $X_4$ is selected from the group consisting of desaminohistidine, desaminohomo-histidine, desaminotyrosine and desaminophenylalanine, R$_4$ is an amino acid sequence selected from the group consisting of
FTSDVSSYLEGQAAKEFIAWLVKGRG (SEQ ID NO: 603),
FTSDVSSYLEGQAAKEFIAWLVKGR-amide (SEQ ID NO: 604),
FTSDVSSYLEGQAAKEFIAWLVKGX$_{14}$PSSGAPPPS-amide (SEQ ID NO: 605), wherein X$_{14}$ is Arg or Gly;
FTSDYSKYLDSRRAQDFVQWLMNT (SEQ ID NO: 618), and
FTSDYSKYLDSRRAQDFVQWLMNTPSSGAPPPS-amide (SEQ ID NO: 620),
R$_5$ is NH$_2$ or HO;
R$_6$ is H or

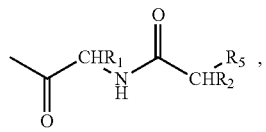

R$_7$ is O or OX$_4$X$_2$X$_3$G (SEQ ID NO: 634); and
R$_1$ and R$_2$ are independently selected from the group consisting of H, C$_1$-C$_3$ alkyl, CH(CH$_3$)(CH$_2$CH$_3$), (C$_4$-C$_5$)cycloalkyl, CH$_2$(C$_6$-C$_{10}$ aryl), and CH$_2$(C$_5$-C$_9$ heteroaryl), and R$_5$ is OH or NH$_2$,
with the proviso that when R$_3$ is

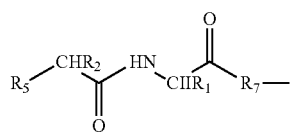

R$_6$ is H, and when R$_6$ is

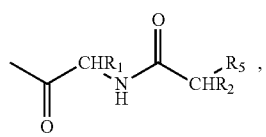

R$_3$ is X$_1$X$_2$X$_3$G-(SEQ ID NO: 621),
further provided that when R$_6$ is H, R$_3$ is not X$_1$X$_2$X$_3$G-(SEQ ID NO: 621). In one embodiment R$_1$ is selected from the group consisting of CH$_2$(CH$_3$)$_2$, (C$_4$-C$_5$)cycloalkyl, CH$_2$(C$_6$-C$_{10}$ aryl), and CH$_2$(C$_5$-C$_9$ heteroaryl) and R$_2$ is selected from the group consisting of (C$_4$-C$_5$)cycloalkyl, CH$_2$(C$_6$-C$_{10}$ aryl) and R$_5$ is OH or NH$_2$.
In one embodiment a GLP-1 prodrug is provided comprising the structure of Formula III:

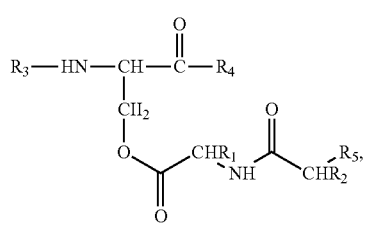

wherein
R$_3$ is an amino acid sequence selected from the group consisting of R$_5$HAQG (SEQ ID NO: 639), R$_5$FAQG (SEQ ID NO: 640), R$_5$YAQG (SEQ ID NO: 641);
R$_4$ comprises an amino acid sequence selected from the group consisting of
FTSDVSSYLEGQAAKEFIAWLVKGRG (SEQ ID NO: 603),
FTSDVSSYLEGQAAKEFIAWLVKGR-amide (SEQ ID NO: 604), and
FTSDVSSYLEGQAAKEFIAWLVKGX$_{14}$PSSGAPPPS-amide (SEQ ID NO: 605), wherein X$_{14}$ is Arg or Gly;
R$_5$ is NH$_2$ or HO; and
R$_1$ and R$_2$ are independently selected from the group consisting of H, C$_1$-C$_3$ alkyl, CH$_2$CH(CH$_3$)$_2$, CH(CH$_3$)(CH$_2$CH$_3$), (C$_4$-C$_5$)cycloalkyl, CH$_2$(C$_6$-C$_{10}$ aryl), and CH$_2$(C$_5$-C$_9$ heteroaryl), and R$_5$ is OH or NH$_2$.
In one embodiment R$_1$ is selected from the group consisting of CH$_2$(CH$_3$)$_2$, (C$_4$-C$_5$)cycloalkyl, CH$_2$(C$_6$ aryl), and CH$_2$(C$_5$-C$_6$ heteroaryl) and R$_2$ is selected from the group consisting of (C$_4$-C$_5$)cycloalkyl, CH$_2$(C$_6$ aryl) and R$_5$ is OH or NH$_2$.

BRIEF DESCRIPTION OF THE DRAWINGS

FIGS. 5A and 5B are schematic representations of the cleavage of the ester linkage by an amine nucleophile bearing prodrug (FIG. 5A) and by a hydroxyl nucleophile bearing prodrug (FIG. 5B) to generate the active compound and a diketopiperazine or diketomopholine, respectively.

FIG. 6A-6D shows the structures of four prodrugs (6A: HO-F5dV6-O-F7,GLP(8-36)-CEX; 6B: F$^5$V$^6$-O-F$^7$,GLP(8-36)-CEX; 6C: HO-F$^5$F$^6$-O-F$^7$,GLP(8-36)-CEX and 6D: G$^5$V$^6$-O-F$^7$,GLP(8-36)CEX) and their respective t½ times.

FIG. 9 is a graph demonstrating the bioassay results of internal serine/threonine GLP derivatives (F$^7$Q$^9$S$^{11}$GLPCEX, ♦ and F$^7$Q$^9$T$^{11}$GLPCEX, ◊) relative to GLP-1 (■).

FIG. 10 is a graph plotting the logarithm of the concentrations of the prodrug and the drug over time, demonstrating the kinetic profile of the prodrug F$^7$Q$^9$-S$^{11}$-(Gly-Gly)-GLP-CEX). The data shows the disappearance of a prodrug (♦) and the appearance of a drug (□) over time. The results shown here are typical of the prodrugs disclosed herein.

FIG. 17 represents a graph of the total food intake of DIO mice injected with vehicle control, a GLP-1-based pegylated peptide at 15 or 70 nmol/kg (Peptides Y and F-Peg), or a prodrug of a GLP-1-based peptide at 15 or 70 nmol/kg (Peptides Z and G-Peg).

FIG. 18 is an alignment of amino acid sequences of certain glucagon superfamily peptides.

DETAILED DESCRIPTION

Definitions

Figure 1:
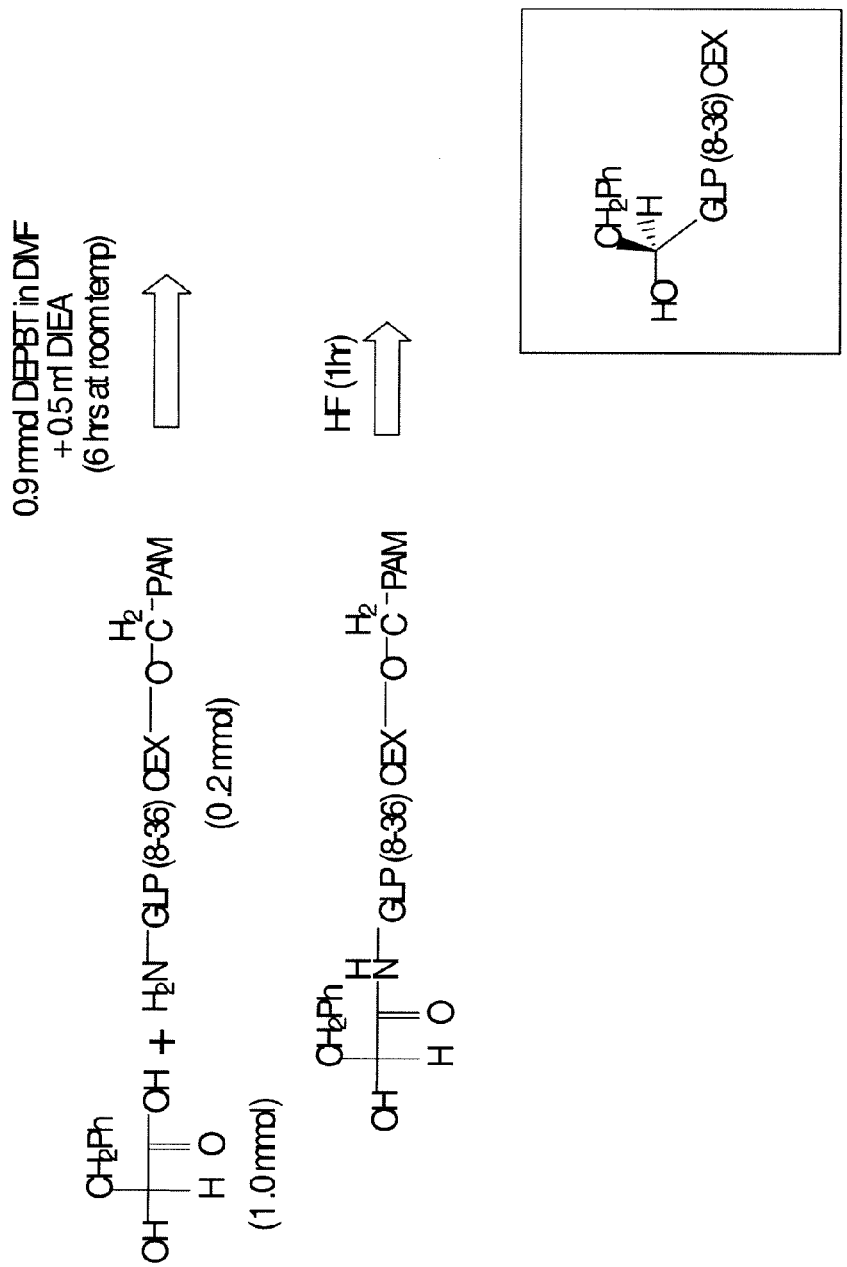
FIG. 1 is a synthetic scheme for preparing the GLP-1 analog HO-FAEGTFTSDVSSYLEGQAAKEFIAWLVKGXPSSGAPPPS (SEQ ID NO: 607; HO-F$^7$, GLP (8-36)-CEX).

In describing and claiming the invention, the following terminology will be used in accordance with the definitions set forth below.

As used herein, the term "prodrug" is defined as any compound that undergoes biotransformation before exhibiting its pharmacological effects.

A "bioactive polypeptide" refers to polypeptides which are capable of exerting a biological effect in vitro and/or in vivo.

As used herein a general reference to a peptide is intended to encompass peptides that have modified amino and carboxy termini. For example, an amino acid chain comprising an amide group in place of the terminal carboxylic acid is intended to be encompassed by an amino acid sequence designating the standard amino acids. As used herein the term "O-amino acid" or "HO-amino acid" designates an amino acid wherein the native amino group at the N-terminus of an amino acid or an amino acid sequence has been replaced with an oxygen or hydroxyl group, respectively. For example, "O-HAEG" or "HO-HAEG" is intended to designate an amino acid sequence (HAEG) wherein the native amino group at the N-terminus has been replaced with an oxygen or hydroxyl group, respectively. The term "hydroxyl acid" or "hydroxyl acid" as used herein refers to an amino acid wherein the native alpha amino group has been replaced with a hydroxyl group. Similarly, the designation "-amino acid-amide" represents an amino acid sequence, wherein the native carboxy group has been replaced with an amide group.

Designation of an amino acid without specifying its stereochemistry is intended to encompass either the L or D form of the amino acid or a racemic mixture.

As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

As used herein the term "pharmaceutically acceptable salt" refers to salts of compounds that retain the biological activity of the parent compound, and which are not biologically or otherwise undesirable. Many of the compounds disclosed herein are capable of forming acid and/or base salts by virtue of the presence of amino and/or carboxyl groups or groups similar thereto.

Pharmaceutically acceptable base addition salts can be prepared from inorganic and organic bases. Salts derived from inorganic bases, include by way of example only, sodium, potassium, lithium, ammonium, calcium and magnesium salts. Salts derived from organic bases include, but are not limited to, salts of primary, secondary and tertiary amines.

Pharmaceutically acceptable acid addition salts may be prepared from inorganic and organic acids. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like.

As used herein, the term "treating" includes prophylaxis of the specific disorder or condition, or alleviation of the symptoms associated with a specific disorder or condition and/or preventing or eliminating said symptoms. For example, as used herein the term "treating diabetes" will refer in general to maintaining glucose blood levels near normal levels and may include increasing or decreasing blood glucose levels depending on a given situation.

As used herein an "effective" amount or a "therapeutically effective amount" of a prodrug refers to a nontoxic but sufficient amount of the prodrug to provide the desired effect. For example one desired effect would be the prevention or treatment of hyperglycemia. The amount that is "effective" will vary from subject to subject, depending on the age and general condition of the individual, mode of administration, and the like. Thus, it is not always possible to specify an exact "effective amount." However, an appropriate "effective" amount in any individual case may be determined by one of ordinary skill in the art using routine experimentation.

The term, "parenteral" means not through the alimentary canal but by some other route such as subcutaneous, intramuscular, intraspinal, or intravenous.

The term "glucagon superfamily peptide" refers to a group of peptides related in structure in their N-terminal and C-terminal regions (see, for example, Sherwood et al., *Endocrine Reviews* 21: 619-670 (2000)). Members of this group include all glucagon related analog peptides, as well as Growth Hormone Releasing Hormone (GHRH; SEQ ID NO: 657), vasoactive intestinal peptide (VIP; SEQ ID NO: 658), Pituitary adenylate cyclase-activating polypeptide 27 (PACAP-27; SEQ ID NO: 659), peptide histidine isoleucine (PHI), peptide histidine methionine (PHM) (SEQ ID NO: 660), and Secretin (SEQ ID NO: 661), and analogs, derivatives or conjugates thereof with up to 1, 2, 3, 4, 5, 6, 7, 8, 9 or 10 amino acid modifications relative to the native peptide. Glucagon superfamily peptides preferably retain the ability to interact with its corresponding receptor. For example, glucagon and glucagon analogs, derivatives, and conjugates thereof preferably retain the ability to interact with the glucagon receptor.

Unless otherwise stated, any reference to an amino acid position in a glucagon superfamily peptide (e.g. for linkage of a prodrug moiety, a conjugate moiety, a hydrophilic polymer, acylation or alkylation, amino acid modification, etc.) refers to the position relative to the native glucagon amino acid sequence (SEQ ID NO: 612), see FIG. 18 for an alignment of representative glucagon superfamily peptides.

The term "glucagon related analog peptide" refers to those peptides which have biological activity (as agonists or antagonists) at any one or more of the glucagon, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon (SEQ ID NO: 612), native oxyntomodulin (SEQ ID NO: 665), native exendin-4 (SEQ ID NO: 662), native GLP-1 (SEQ ID NOs: 601 and 602), native GLP-2 (SEQ ID NO: 663), or native GIP (SEQ ID NO: 664). Unless otherwise stated, any reference to an amino acid position in a glucagon related analog peptide (e.g. for linkage of a prodrug moiety, a conjugate moiety, a hydrophilic polymer, acylation or alkylation, amino acid modification, etc.) refers to the position relative to the native glucagon amino acid sequence (SEQ ID NO: 612).

The term "identity" as used herein relates to the similarity between two or more sequences. Identity is measured by dividing the number of identical residues by the total number of residues and multiplying the product by 100 to achieve a percentage. Thus, two copies of exactly the same sequence have 100% identity, whereas two sequences that have amino acid deletions, additions, or substitutions relative to one another have a lower degree of identity. Those skilled in the art will recognize that several computer programs, such as those that employ algorithms such as BLAST (Basic Local Alignment Search Tool, Altschul et al. (1993) *J. Mol. Biol.* 215:403-410) are available for determining sequence identity.

The term "GLP-1 agonist" refers to a compound that stimulates GLP-1 receptor activity, as measured by cAMP production using a validated in vitro model assay, such as that described in Example 2.

As used herein the term "native GLP-1" is a generic term that designates GLP-1(7-36)amide (consisting of the sequence of SEQ ID NO: 602), GLP-1(7-37)acid (consisting of the sequence of SEQ ID NO: 601) or a mixture of those two compounds. As used herein, a general reference to "GLP-1" in the absence of any further designation is intended to mean native GLP-1, respectively.

As used herein the term "glucagon peptide" is a generic term that designates the natural glucagon peptide of SEQ ID NO: 612 as well as modified derivatives having one or more amino acid substitutions at amino acid positions 1, 2, 5, 7, 8, 10, 12, 13, 14, 16, 17, 18, 24, 28 and 29, relative to the sequence of SEQ ID NO: 612.

As used herein the term "GLP-1 peptide" is a generic term that designates native GLP-1 as well as modified derivatives having one or more amino acid substitutions at amino acid positions 1, 2, 3, 5, 8, 10, 12, 13, 14, 16, 17, 18, 24, 28 and 29, relative to the native GLP-1 sequence.

As used herein the term "insulin peptide" is a generic term that designates the 51 amino acid dimer comprising the A chain of SEQ ID NO: 613 and the B chain of SEQ ID NO: 614 as well as modified derivatives of the A chain and/or B chain, including one or more amino acid substitutions at positions selected from A5, A8, A9, A10, A12, A14, A15, A17, A18, A21, B1, B2, B3, B4, B5, B9, B10, B13, B14, B17, B20, B21, B22, B23, B26, B27, B28, B29 and B30 or deletions of any or all of positions B1-5 and B26-30.

As used herein an amino acid "modification" refers to a substitution, addition or deletion of an amino acid, and includes substitution with or addition of any of the 20 amino acids commonly found in human proteins, as well as atypical or non-naturally occurring amino acids. Commercial sources of atypical amino acids include Sigma-Aldrich (Milwaukee, Wis.), ChemPep Inc. (Miami, Fla.), and Genzyme Pharmaceuticals (Cambridge, Mass.). Atypical amino acids may be purchased from commercial suppliers, synthesized de novo, or chemically modified or derivatized from naturally occurring amino acids.

As used herein an amino acid "substitution" refers to the replacement of one amino acid residue by a different amino acid residue.

As used herein, the term "conservative amino acid substitution" is defined herein as exchanges within one of the following five groups:

I. Small aliphatic, nonpolar or slightly polar residues:
Ala, Ser, Thr, Pro, Gly;
II. Polar, negatively charged residues and their amides:
Asp, Asn, Glu, Gln;
III. Polar, positively charged residues:
His, Arg, Lys; Ornithine (Orn)
IV. Large, aliphatic, nonpolar residues:
Met, Leu, Ile, Val, Cys, Norleucine (Nle), homocysteine
V. Large, aromatic residues:
Phe, Tyr, Trp, acetyl phenylalanine As used herein the general term "polyethylene glycol chain" or "PEG chain", refers to mixtures of condensation polymers of ethylene oxide and water, in a branched or straight chain, represented by the general formula $H(OCH_2CH_2)_nOH$, wherein n is at least 9. Absent any further characterization, the term is intended to include polymers of ethylene glycol with an average total molecular weight selected from the range of 500 to 80,000 Daltons. "Polyethylene glycol chain" or "PEG chain" is used in combination with a numeric suffix to indicate the approximate average molecular weight thereof. For example, PEG-5,000 refers to polyethylene glycol chain having a total molecular weight average of about 5,000 Daltons.

As used herein the term "pegylated" and like terms refers to a compound that has been modified from its native state by linking a polyethylene glycol chain to the compound. A "pegylated polypeptide" is a polypeptide that has a PEG chain covalently bound to the polypeptide.

As used herein a "linker" is a bond, molecule or group of molecules that binds two separate entities to one another. Linkers may provide for optimal spacing of the two entities or may further supply a labile linkage that allows the two entities to be separated from each other. Labile linkages include photocleavable groups, acid-labile moieties, base-labile moieties and enzyme-cleavable groups.

As used herein a "dimer" is a complex comprising two subunits covalently bound to one another via a linker. The term dimer, when used absent any qualifying language, encompasses both homodimers and heterodimers. A homodimer comprises two identical subunits, whereas a heterodimer comprises two subunits that differ, although the two subunits are substantially similar to one another.

The term "$C_1$-$C_n$ alkyl" wherein n can be from 1 through 6, as used herein, represents a branched or linear alkyl group having from one to the specified number of carbon atoms. Typical $C_1$-$C_6$ alkyl groups include, but are not limited to, methyl, ethyl, n-propyl, iso-propyl, butyl, iso-butyl, sec-butyl, tert-butyl, pentyl, hexyl and the like.

The terms "$C_2$-$C_n$ alkenyl" wherein n can be from 2 through 6, as used herein, represents an olefinically unsaturated branched or linear group having from 2 to the specified number of carbon atoms and at least one double bond. Examples of such groups include, but are not limited to, 1-propenyl, 2-propenyl (—$CH_2$—CH=$CH_2$), 1,3-butadienyl, (—CH=CHCH=$CH_2$), 1-butenyl (—CH=CH$CH_2$$CH_3$), hexenyl, pentenyl, and the like.

The term "$C_2$-$C_n$ alkynyl" wherein n can be from 2 to 6, refers to an unsaturated branched or linear group having from 2 to n carbon atoms and at least one triple bond. Examples of such groups include, but are not limited to, 1-propynyl, 2-propynyl, 1-butynyl, 2-butynyl, 1-pentynyl, and the like.

As used herein the term "aryl" refers to a mono- or bicyclic carbocyclic ring system having one or two aromatic rings including, but not limited to, phenyl, naphthyl, tetrahydronaphthyl, indanyl, indenyl, and the like. The size of the aryl ring and the presence of substituents or linking groups are indicated by designating the number of carbons present. For example, the term "($C_1$-$C_3$ alkyl)($C_6$-$C_{10}$ aryl)" refers to a 5 to 10 membered aryl that is attached to a parent moiety via a one to three membered alkyl chain.

The term "heteroaryl" as used herein refers to a mono- or bi-cyclic ring system containing one or two aromatic rings and containing at least one nitrogen, oxygen, or sulfur atom in an aromatic ring. The size of the heteroaryl ring and the presence of substituents or linking groups are indicated by designating the number of carbons present. For example, the term "($C_1$-$C_n$ alkyl)($C_5$-$C_6$ heteroaryl)" refers to a 5 or 6 membered heteroaryl that is attached to a parent moiety via a one to "n" membered alkyl chain.

As used herein the term "charged amino acid" refers to an amino acid that comprises a side chain that is negatively charged (i.e., de-protonated) or positively charged (i.e., protonated) in aqueous solution at physiological pH. For example negatively charged amino acids include aspartic acid, glutamic acid, cysteic acid, homocysteic acid, and homoglutamic acid, whereas positively charged amino acids include arginine, lysine and histidine. Charged amino acids include the charged amino acids among the 20 amino acids commonly found in human proteins, as well as atypical or non-naturally occurring amino acids.

As used herein the term "acidic amino acid" refers to an amino acid that comprises a second acidic moiety, including for example, a carboxylic acid or sulfonic acid group.

As used herein the term "patient" without further designation is intended to encompass any warm blooded vertebrate domesticated animal (including for example, but not limited to livestock, horses, cats, dogs and other pets) and humans.

EMBODIMENTS

The present disclosure describes the formulation of prodrug derivatives of known bioactive polypeptides. More particularly, the prodrugs disclosed herein are formulated to enhance the half life of the parent bioactive peptide or protein, while allowing for activation of the prodrug via a non-enzymatic degradation mechanism. The ideal prodrug should be soluble in water at physiological conditions (for example, a pH of 7.2 and 37° C.), and it should be stable in the powder form for long term storage. It should also be immunologically silent and exhibit a low activity relative to the parent drug. Typically the prodrug will exhibit no more than 10% of the activity of the parent drug, in one embodiment the prodrug exhibits less than 10%, less than 5%, about 1%, or less than 1% activity relative to the parent drug. Furthermore, the prodrug, when injected in the body, should be quantitatively converted to the active drug within a defined period of time. As disclosed herein, applicants have provided a general technique for producing prodrugs of known bioactive polypeptides that meets each of these objectives.

More particularly, a chemoreversible prodrug is provided comprising the sequence of a known bioactive polypeptide modified to have a dipeptide covalently bound to the bioactive polypeptide via an ester linkage. In one embodiment a prodrug is provided having a non-enzymatic activation half time (t½) of between 1-100 hrs under physiological conditions. Physiological conditions as disclosed herein are intended to include a temperature of about 35 to 40° C. and a pH of about 7.0 to about 7.4 and more typically include a pH of 7.2 to 7.4 and a temperature of 36 to 38° C.

Advantageously, the rate of cleavage, and thus activation of the prodrug, depends on the structure and stereochemistry of the dipeptide pro-moiety and also on the strength of the nucleophile. The prodrugs disclosed herein will ultimately be chemically converted to structures that can be recognized by the native receptor of the drug, wherein the speed of this chemical conversion will determine the time of onset and duration of in vivo biological action. The molecular design disclosed in this application relies upon an intramolecular chemical reaction that is not dependent upon additional chemical additives, or enzymes. The speed of conversion is controlled by the chemical nature of the dipeptide substituent and its cleavage under physiological conditions. Since physiological pH and temperature are tightly regulated within a highly defined range, the speed of conversion from prodrug to drug will exhibit high intra and interpatient reproducibility.

As disclosed herein prodrugs are provided wherein the bioactive polypeptides have extended half lives of at least 1 hour, and more typically greater than 20 hours but less than 100 hours, and are converted to the active form at physiological conditions through a non-enzymatic reaction driven by inherent chemical instability. In one embodiment the a non-enzymatic activation t½ time of the prodrug is between 1-100 hrs, and more typically between 12 and 72 hours, and in one embodiment the t½ is between 24-48 hrs as measured by incubating the prodrug in a phosphate buffer solution (e.g., PBS) at 37° C. and pH of 7.2. The half lives of the various prodrugs are calculated by using the formula $t_{1/2}=0.693/k$, where 'k' is the first order rate constant for the degradation of the prodrug. In one embodiment, activation of the prodrug occurs after cleavage of an ester bond linked dipeptide, and formation of a diketopiperazine or diketomorpholine, and the active bioactive polypeptide (see FIGS. 5A & 5B). Specific dipeptides composed of natural or synthetic amino acids have been identified that facilitate intramolecular decomposition under physiological conditions to release bioactive peptides.

The prodrug chemistry is broadly applicable to peptide and protein based drugs where an aliphatic hydroxyl group can be accommodated in the active site, and when the chemically modified derivative yields a poorly active (e.g., having 10% or less activity relative to the parent) peptide or protein. A specific example to illustrate this point would be the formation of reversible serine esters, at the active site serine, in the family of serine proteases. Medicinally important peptides and proteins where this prodrug technology can be employed, include but are not limited to insulin, glucagon and glucagon related peptides (GLPs, oxyntomodulin), gastrin inhibitory peptide (GIP), growth hormone releasing hormone (GHRH), calcitonin, parathyroid hormone (PTH), neuropeptide Y (NPY), pancreatic polypeptide (PP), and related substances. Medicinally important proteins where this prodrug technology can be employed include but are not limited to growth hormone, erythropoietin (EPO), neutrophil stimulating growth factors (CGSF), interferons, blood coagulation enzymes, antibodies, leptin and the like. In accordance with one embodiment, a prodrug derivative of glucagon, insulin, GLP-1, or a modified derivative of glucagon, insulin or GLP-1, are provided. As used herein a modified derivative of glucagon, insulin or GLP-1 includes, for example, a polypeptide that differs from the native sequence of glucagon, insulin or GLP, respectively, by 1, 2, 3, 4, 5, or 6 amino acid substitutions.

In accordance with one embodiment an aliphatic hydroxyl group of the bioactive peptide or protein, including for example the hydroxyl bearing side chain of a serine or threonine residue or the hydroxyl group of an N-terminal hydroxylated amino acid (HO-amino acid), is modified by the covalent linkage of the group:

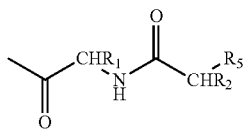

to the bioactive polypeptide via an ester linkage, wherein $R_1$ and $R_2$ are independently selected from the group consisting of H, $C_1$-$C_6$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$) NH$_2$, ($C_4$-$C_6$) cycloalkyl, ($C_0$-$C_4$ alkyl)($C_6$-$C_{10}$ aryl)R$_9$, and CH$_2$($C_5$-$C_9$ heteroaryl) and $R_5$ is OH or NH$_2$.

In some embodiments, the bioactive peptide is a glucagon superfamily peptide (e.g., a glucagon related analog peptide), osteocalcin, or an analog, derivative, or conjugate of one of the foregoing.

In one embodiment the bioactive protein is glucagon, GLP-1 or insulin.

In one embodiment $R_1$ and $R_2$ are independently selected from the group consisting of H, $C_1$-$C_3$ alkyl, CH$_2$CH(CH$_3$)$_2$, CH(CH$_3$)(CH$_2$CH$_3$), ($C_4$-$C_5$)cycloalkyl, CH$_2$($C_6$-$C_{10}$ aryl), and CH$_2$($C_5$-$C_9$ heteroaryl), and $R_5$ is OH or NH$_2$. In one embodiment $R_1$ is selected from the group consisting of CH$_2$(CH$_3$)$_2$, ($C_4$-$C_5$)cycloalkyl, CH$_2$($C_6$-$C_{10}$ aryl), and CH$_2$($C_5$-$C_9$ heteroaryl), $R_2$ is selected from the group consisting of ($C_4$-$C_5$)cycloalkyl, CH$_2$($C_6$-$C_{10}$ aryl) and CH$_2$($C_5$-$C_9$ heteroaryl), and $R_5$ is OH or NH$_2$.

In accordance with one embodiment a prodrug is provided comprising the general structure of Formula I:

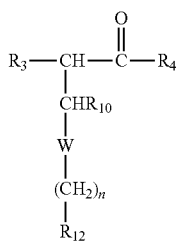

I wherein $R_3$ is selected from the group consisting of NH$_2$, HO—, an amino acid sequence, and

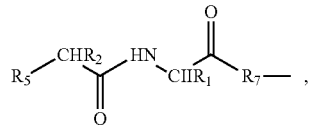

$R_4$ is —OH, NH$_2$, or an amino acid sequence,
$R_{10}$ is selected from the group consisting of H, $C_1$-$C_4$ alkyl, and (CH$_2$)$_a$($C_6$-$C_{10}$ aryl), W is $C_6$-$C_{10}$ aryl or a bond, and
n is an integer from 0 to 3,
$R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl) COOH, ($C_1$-$C_4$ alkyl)NH$_2$, ($C_1$-$C_4$ alkyl)NHC(NH$_2^+$) NH$_2$, ($C_4$-$C_6$)cycloalkyl, ($C_0$-$C_4$ alkyl)($C_6$-$C_{10}$ aryl)R$_9$, and CH$_2$ ($C_5$-$C_9$ heteroaryl),
$R_5$ is OH or NH$_2$ and
$R_9$=$C_1$-$C_4$ alkyl, NH$_2$ or OH,
wherein $R_7$ is —O-amino acid or O, and
$R_{12}$ is —OH or

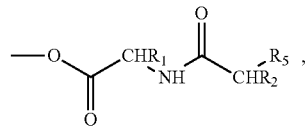

with the proviso that $R_3$ is not

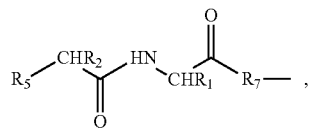

when $R_{12}$ is

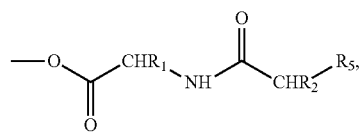

and with the further proviso that $R_{12}$ is

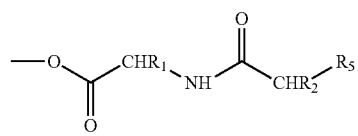

when $R_3$ is NH$_2$ or an amino acid sequence.

In some embodiments, $R_3$ or $R_4$ is an amino acid sequence of a bioactive peptide. In more specific embodiments, $R_3$ is an amino acid sequence of the bioactive peptide which is N-terminal to an amino acid of the bioactive peptide comprising a side chain of structure

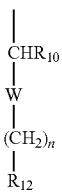

and $R_4$ is an amino acid sequence of the bioactive peptide which is C-terminal to the amino acid of the bioactive peptide.

In some embodiments, when $R_3$ is

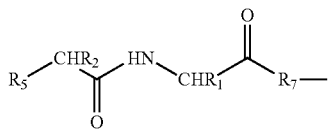

and $R_7$ is O-amino acid, $R_7$ is an amino acid sequence of the bioactive peptide which is N-terminal to an amino acid of the bioactive peptide comprising a side chain of structure

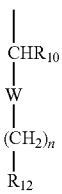

and $R_4$ is an amino acid sequence of the bioactive peptide which is C-terminal to the amino acid of the bioactive peptide.

In one embodiment $R_3$ is

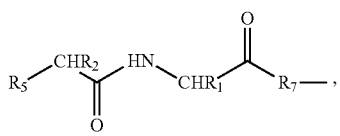

and $R_7$ and $R_4$ represent amino acid sequences from glucagon, GLP-1 or insulin peptides.

In an alternative embodiment $R_3$ is an N-terminal sequence selected from either glucagon, GLP-1 or insulin peptides, $R_4$ is a carboxy terminal sequence selected from either glucagon, GLP-1 or insulin peptides and $R_{12}$ is

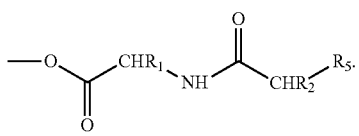

In accordance with one embodiment a prodrug derivative of a bioactive protein is provided comprising the general structure of Formula II:

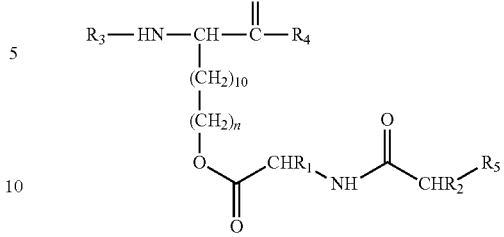

wherein $R_3$ is H or the N-terminal amino acids of the bioactive protein (e.g., a glucagon, GLP-1 or insulin peptide), $R_4$ represents OH or the C-terminal amino acids of the bioactive protein (e.g., a glucagon, GLP-1 or insulin peptide), $R_{10}$ is selected from the group consisting of H, $C_1$-$C_4$ alkyl, and $(CH_2)_n(C_6$-$C_{10}$ aryl), wherein n is an integer from 0 to 3

$R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$) NH$_2$, ($C_4$-$C_6$)cycloalkyl, ($C_0$-$C_4$ alkyl)($C_6$-$C_{10}$ aryl)$R_9$, and CH$_2$($C_5$-$C_9$ heteroaryl), wherein $R_5$ is OH or NH$_2$ and $R_9$=$C_1$-$C_4$ alkyl, NH$_2$ or OH.

In one embodiment $R_1$ is selected from the group consisting of CH(CH$_3$)$_2$, CH$_2$CH(CH$_3$)$_2$, CH(CH$_3$)(CH$_2$CH$_3$), ($C_4$-$C_5$)cycloalkyl, ($C_0$-$C_4$ alkyl)($C_6$ aryl), and ($C_0$-$C_4$ alkyl)($C_5$-$C_9$ heteroaryl), $R_2$ is selected from the group consisting of ($C_0$-$C_4$ alkyl)$C_1$-$C_4$ alkyl, ($C_4$-$C_5$)cycloalkyl, ($C_0$-$C_4$ alkyl)($C_6$ aryl), and ($C_0$-$C_4$ alkyl)($C_5$-$C_9$ heteroaryl), and $R_5$ is OH or NH$_2$.

In one embodiment the dipeptide is linked to the bioactive polypeptide through the hydroxyl group of a serine or threonine residue (i.e., n is 0 and $R_{10}$ is H, or n is 0 and $R_{10}$ is CH$_3$ in the compound of Formula III). More particularly the modified serine or threonine residue is located in a protein binding domain or active site, such that attachment of the dipeptide interferes with the bioactive polypeptide's ability to interact with its native receptor or substrate.

With regard to the prodrugs of general structure of Formula II, at least one of $R_3$ or $R_4$ represent amino acids of the bioactive peptide. In some embodiments, $R_3$ and $R_4$ represent amino acids of the bioactive peptide.

In accordance with one embodiment a polypeptide is provided having the general structure of Formula II wherein $R_3$ is selected from the group consisting of H and an amino acid sequence, $R_4$ is —OH or an amino acid sequence, $R_{10}$ is selected from the group consisting of H, $C_1$-$C_4$ alkyl, and $(CH_2)_n(C_6$-$C_{10}$ aryl), wherein n is an integer from 0 to 3;

$R_1$ is selected from the group consisting of CH(CH$_3$)$_2$, CH$_2$CH(CH$_3$)$_2$, CH(CH$_3$)(CH$_2$CH$_3$), ($C_4$-$C_5$)cycloalkyl, ($C_0$-$C_4$ alkyl)($C_6$ aryl), and ($C_0$-$C_4$ alkyl)($C_5$-$C_6$ heteroaryl), $R_2$ is selected from the group consisting of ($C_0$-$C_4$ alkyl) $C_1$-$C_4$ alkyl, ($C_4$-$C_5$)cycloalkyl, ($C_0$-$C_4$ alkyl)($C_6$ aryl), and ($C_0$-$C_4$ alkyl)($C_5$-$C_6$ heteroaryl), and $R_5$ is OH or NH$_2$.

In a further embodiment $R_{10}$ is H and n is 0.

In accordance with one embodiment a prodrug is provided having the general structure of Formula IV:

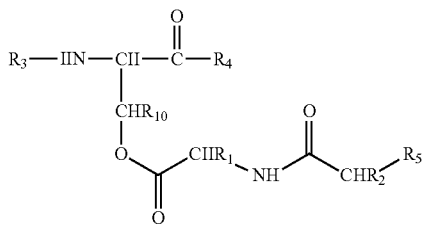

IV wherein $R_3$ is H or the N-terminal amino acids of the bioactive protein located upstream of a serine/threonine residue present (either naturally or as an amino acid substitution) in the bioactive polypeptide, $R_4$ represents OH or the C-terminal amino acids of the bioactive protein located downstream of a serine/theronine residue present (either naturally or as an amino acid substitution) in the bioactive polypeptide (acid or amide), $R_{10}$ is H or $CH_3$, wherein a serine/theronine moiety located within said bioactive protein has been modified by the covalent linkage of the group:

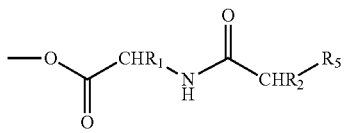

wherein $R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)$NHC(NH_2^+)$ $NH_2$, ($C_4$-$C_6$)cycloalkyl, ($C_0$-$C_4$ alkyl)($C_6$-$C_{10}$ aryl)$R_9$, and $CH_2$($C_5$-$C_9$ heteroaryl), $R_5$ is OH or $NH_2$; and $R_9=C_1$-$C_4$ alkyl, $NH_2$ or OH.

In one embodiment $R_1$ is selected from the group consisting of $CH(CH_3)_2$, $CH_2CH(CH_3)_2$, $CH(CH_3)(CH_2CH_3)$, ($C_4$-$C_5$)cycloalkyl, ($C_0$-$C_4$ alkyl)($C_6$-$C_{10}$ aryl), and ($C_0$-$C_4$ alkyl)($C_5$-$C_9$ heteroaryl), $R_2$ is selected from the group consisting of ($C_0$-$C_4$ alkyl)$C_1$-$C_4$ alkyl, ($C_4$-$C_5$)cycloalkyl, ($C_0$-$C_4$ alkyl)($C_6$-$C_{10}$ aryl), and ($C_0$-$C_4$ alkyl)($C_5$-$C_9$ heteroaryl), and $R_5$ is OH or $NH_2$. In one embodiment the serine/threonine residue selected for modification is located in a protein binding domain or active site, such that attachment of the dipeptide interferes with the bioactive polypeptide's ability to interact with its native receptor or substrate.

With regard to the prodrugs comprising the general structure of Formula II or Formula IV, at least one of $R_3$ or $R_4$ represents amino acids of the bioactive peptide. In some embodiments, both of $R_3$ and $R_4$ represent amino acids of the bioactive peptide. In some embodiments, R3 is an amino acid sequence of the bioactive peptide which is N-terminal to an amino acid of the bioactive peptide comprising a side chain of structure

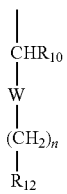

and R4 is an amino acid sequence of the bioactive peptide which is C-terminal to the amino acid of the bioactive peptide.

In accordance with one embodiment, the bioactive polypeptide is selected from the group consisting of insulin, glucagon, GLP-1 and derivatives of those polypeptides wherein the derivatives differ by 1, 2, 3, 4, 5 or 6 amino acids relative to the native sequence. In one embodiment the insulin, glucagon, GLP-1 derivative differs from the native sequence by 1, 2, 3, 4, 5 or 6 conservative amino acids substitutions.

In one embodiment the prodrug comprises the general structure of Formula III:

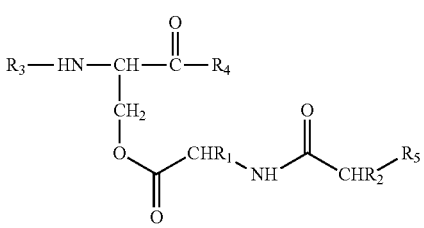

III wherein $R_3$ comprises the native N-terminal amino acids of a bioactive protein, $R_4$ comprises the native C-terminal amino acids of the bioactive protein, wherein $R_1$ and $R_2$ are independently selected from the group consisting of H, $C_1$-$C_3$ alkyl, $CH_2CH(CH_3)_2$, $CH(CH_3)(CH_2CH_3)$, ($C_4$-$C_5$)cycloalkyl, $CH_2(C_6$-$C_{10}$ aryl), and $CH_2(C_5$-$C_9$ heteroaryl), and $R_5$ is OH or $NH_2$, wherein the a non-enzymatic activation t½ is between 10-100 hrs. In one embodiment the t½ of the prodrug is between 20-70 hrs.

In one embodiment $R_1$ is selected from the group consisting of $CH_2(CH_3)_2$, ($C_4$-$C_5$)cycloalkyl, $CH_2(C_6$ aryl), and $CH_2(C_5$-$C_6$ heteroaryl), $R_2$ is selected from the group consisting of ($C_4$-$C_5$)cycloalkyl, $CH_2(C_6$ aryl) and $CH_2(C_5$-$C_6$ heteroaryl), and $R_5$ is OH or $NH_2$.

In some embodiments, wherein the prodrug comprises the general structure of Formula III, $R_3$ comprises the N-terminal amino acids of the bioactive protein which are N-terminal to an amino acid of the bioactive protein comprising a side chain of structure

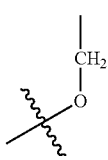

and R4 comprises C-terminal amino acids of the bioactive protein which are C-terminal to the amino acid of the bioactive protein.

In accordance with one embodiment, the bioactive polypeptide is selected from the group consisting of insulin, glucagon, GLP-1 and derivatives of insulin, glucagon and GLP-1 wherein the derivative polypeptides comprise 1 to 6 amino acid substitutions relative to the native sequence. The substituting amino acids can be either natural amino acids or synthetic amino acids, and in one embodiment the amino acid substitutions represent conservative amino acid substitutions.

Bioactive Peptides, Polypeptides, and Proteins

The bioactive peptide, bioactive polypeptide, or bioactive protein linked via an ester bond to the prodrug dipeptide moiety can be a glucagon superfamily peptide (e.g., a member of the glucagon superfamily (those described in Sherwood et al., 2000, supra), a glucagon related analog peptide), osteocalcin, insulin, or an analog, derivative, or conjugate thereof.

Osteocalcin

In some embodiments, the bioactive peptide is osteocalcin or an analog or derivative thereof comprising an amino acid sequence which is at least about 40%, 45%, 50%, 55%, 60%, 65%, 70%, 75%, 80%, 85%, 90%, or 95% identical to native osteocalcin over the length of the native peptide. In a related embodiment, the bioactive peptide may comprise an analog of osteocalcin with up to 1, 2, 3, 4, 5, 6, 7, 8, 9 or 10 amino acid modifications relative to native osteocalcin.

Insulin

In other embodiments, the bioactive peptide is insulin, or an analog or derivative thereof comprising an A chain and a B chain, each chain comprising an amino acid sequence which is at least about 40%, 45%, 50%, 55%, 60%, 65%, 70%, 75%, 80%, 85%, 90%, or 95% identical to native A or B chain of insulin over the length of the native peptide. In related embodiments, the insulin analog or derivative may comprise an analog of an insulin A or B chain with up to 1, 2, 3, 4, 5, 6, 7, 8, 9 or 10 amino acid modifications relative to the native A or B insulin chain. In specific embodiments, the A chain of insulin comprises an amino acid sequence of SEQ ID NO: 613 or SEQ ID NO: 626, or an analog of derivative thereof (e.g., having at least about 40%, 45%, 50%, 55%, 60%, 65%, 70%, 75%, 80%, 85%, 90%, or 95% identity to SEQ ID NO: 613 or 626 or having up to 1, 2, 3, 4, 5, 6, 7, 8, 9 or 10 amino acid modifications relative to SEQ ID NO: 613 or 626). Additionally, in some embodiments, the B chain of insulin can comprise an amino acid sequence of SEQ ID NO: 614, SEQ ID NO: 627, or SEQ ID NO: 628, or an analog or derivative thereof (e.g., having at least about 40%, 45%, 50%, 55%, 60%, 65%, 70%, 75%, 80%, 85%, 90%, or 95% identity to SEQ ID NO: 614, SEQ ID NO: 627, or SEQ ID NO: 628 or having up to 1, 2, 3, 4, 5, 6, 7, 8, 9 or 10 amino acid modifications relative to SEQ ID NO: 614, SEQ ID NO: 627, or SEQ ID NO: 628.

Glucagon Superfamily Peptide

In yet other embodiments, the bioactive peptide is any of the glucagon superfamily peptides that are known in the art, including, for example, GHRH (SEQ ID NO: 657), VIP (SEQ ID NO: 658), PACAP-27 (SEQ ID NO: 659), PHM (SEQ ID NO: 660), Secretin (SEQ ID NO: 661), glucagon (SEQ ID NO: 612), exendin-4 (SEQ ID NO: 662), Glucagon-like peptide-1 (GLP-1) (e.g., amino acids 7-37 provided as SEQ ID NO: 601), Glucagon-like peptide-2 (GLP-2) (SEQ ID NO: 663), GIP (SEQ ID NO: 664) and Oxyntomodulin (SEQ ID NO: 665).

Glucagon superfamily peptides may have common structural characteristics, including but not limited to homology within the N-terminal amino acids and/or alpha-helical structure within the C-terminal portion. It is believed that the C-terminus generally functions in receptor binding and the N-terminus generally functions in receptor signaling. A few amino acids in the N-terminal portion and C-terminal portion, for example, His1, Gly4, Phe6, Phe22, Val23, Trp25, and Leu26 (according to the amino acid numbering of Glucagon), are highly conserved among members of the glucagon superfamily, such that the amino acids of the member of the glucagon superfamily at the corresponding positions show identity, are conservatively substituted or otherwise exhibit similarity in amino acid side chains.

The glucagon superfamily peptide may be an analog or derivative of GHRH (SEQ ID NO: 657), VIP (SEQ ID NO: 658), PACAP-27 (SEQ ID NO: 659), PHM (SEQ ID NO: 660), Secretin (SEQ ID NO: 661), glucagon (SEQ ID NO: 612), exendin-4 (SEQ ID NO: 662), Glucagon-like peptide-1 (GLP-1) (e.g., amino acids 7-37 provided as SEQ ID NO: 601), Glucagon-like peptide-2 (GLP-2) (SEQ ID NO: 663), GIP (SEQ ID NO: 664) and Oxyntomodulin (SEQ ID NO: 665) comprising the native amino acid sequence with up to 1, 2, 3, 4, 5, 6, 7, 8, 9 or 10 amino acid modifications.

For example, the glucagon superfamily peptide may comprise a C-terminus or a C-terminal amino acid sequence including but not limited to: COOH, CONH$_2$, GPSSGAPPPS (SEQ ID NO: 624), GPSSGAPPPS-CONH$_2$ (SEQ ID NO: 723), a oxyntomodulin carboxy terminal extension, KRNRNNIA (SEQ ID NO: 625) or KGKKNDWKHNITQ (SEQ ID NO: 666). Additional, C-terminal amino acid sequences for glucagon superfamily peptides are further detailed below.

Also, for example, the glucagon superfamily peptide can be an analog of GHRH (SEQ ID NO: 657) comprising an amino acid sequence that is at least about 40%, 45%, 50%, 55%, 60%, 65%, 70%, 75%, 80%, 85%, 90%, or 95% identical to native GHRH over the length of the native peptide. The glucagon superfamily peptide may comprise an analog of GHRH with up to 1, 2, 3, 4, 5, 6, 7, 8, 9 or 10 amino acid modifications relative to native GHRH.

In still further embodiments, the bioactive peptide can comprise an amino acid sequence which is a chimera of two or more native glucagon related analog peptide sequences. In some embodiments, the bioactive peptide comprises an amino acid sequence that is at least about 50% identical to native glucagon (SEQ ID NO: 612) and retains the alpha-helix conformation of the amino acids corresponding to amino acids 12-29 of SEQ ID NO: 612.

The bioactive peptide may be a conjugate of a glucagon superfamily peptide. Conjugates are further described herein with regard to glucagon related analog peptides. The teachings of conjugates in this context generally apply to the bioactive peptides which are not glucagon related analog peptides.

In some embodiments, the glucagon superfamily peptide is a glucagon related analog peptide, e.g. glucagon (SEQ ID NO: 612), oxyntomodulin (SEQ ID NO: 665), exendin-4 (SEQ ID NO: 662), Glucagon-like peptide-1 (GLP-1) (amino acids 7-37 provided as SEQ ID NO: 601), Glucagon-like peptide-2 (GLP-2) (SEQ ID NO: 663), GIP (SEQ ID NO: 664) or analogs, derivatives and conjugates of the foregoing. In some embodiments, the glucagon related analog peptide comprises an amino acid sequence of native glucagon, native exendin-4, native (7-37)GLP-1, native GLP-2, native GHRH, native VIP, native PACAP-27, native PHM, native Oxyntomodulin, native Secretin, or native GIP with up to 1, 2, 3, 4, 5, 6, 7, 8, 9 or 10 amino acid modifications. Such peptides are known in the art. See, e.g., WO 2008023050, WO 2007030519, WO 2005058954, WO 2003011892, WO 2007046834, WO 2006134340, WO 2006124529, WO 2004022004, WO 2003018516, and WO 2007124461, each incorporated herein by reference in its entirety.

In related embodiments, the glucagon related analog peptide comprises an amino acid sequence that is at least about 40%, 45%, 50%, 55%, 60%, 65%, 70%, 75%, 80%, 85%, 90%, or 95% identical to the corresponding sequence of native glucagon, native oxyntomodulin, native exendin-4, native (7-37)GLP-1, native GLP-2, or native GIP over the length of the native peptide (or over the positions which correspond to glucagon, see e.g., FIG. 18).

In certain embodiments, the glucagon related analog peptide is a Class 1, 2, 3, 4 or 5 glucagon related analog peptide as detailed herein.

Glucagon Related Analog Peptide

In certain aspects the instant disclosure concerns glucagon related analog peptides. The term glucagon related analog peptide refers to those peptides which have biological activity (as agonists or antagonists) at any one or more of the glucagon, oxyntomodulin, exendin-4, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon, native oxyntomodulin, native exendin-4, native GLP-1, native GLP-2, or native GIP. It is understood that all possible activity subsets of glucagon related analog peptides are contemplated, e.g. peptides which have biological activity (as agonists or antagonists) at any one or more of the glucagon or GLP-1 or GIP receptors, together with all possible subsets of sequence identity to each listed native peptide, e.g., comprise an amino acid sequence that shares at least 40%, 45%, 50%, 55%, 60%, 65%, 70%, 75%, 80%, 85%, 90%, or 95% sequence identity with native glucagon over the length of native glucagon.

In one embodiment of the invention, the glucagon related analog peptide is a peptide having glucagon receptor agonist activity, GIP receptor agonist activity, glucagon receptor/GLP-1 receptor co-agonist activity, glucagon receptor antagonist activity, or glucagon receptor antagonist & GLP-1 receptor agonist activity. In some embodiments, the peptide retains an alpha-helix conformation in the C-terminal half of the molecule. In some embodiments, the peptide retains positions involved in receptor interaction or signaling, e.g. position 3 of glucagon, or position 7, 10, 12, 13, 15 or 17 of (1-37)GLP-1. Accordingly, the glucagon related analog peptide can be a peptide of Class 1, Class 2, Class 3, Class 4, and/or Class 5, each of which is further described herein.

Modifications

The glucagon related analog peptide can comprise the native glucagon amino acid sequence (SEQ ID NO: 612) with modifications. In exemplary embodiments, the glucagon related analog peptide may comprise a total of 1, up to 2, up to 3, up to 4, up to 5, up to 6, up to 7, up to 8, up to 9, or up to 10 amino acid modifications relative to the native glucagon sequence, e.g. conservative or non-conservative substitutions. Modifications and substitutions described herein are, in certain aspects made at specific positions within a glucagon related analog peptide wherein the numbering of the position corresponds to the numbering of glucagon (SEQ ID NO: 612). In some embodiments 1, 2, 3, 4 or 5 non-conservative substitutions are carried out at any of positions 2, 5, 7, 10, 11, 12, 13, 14, 17, 18, 19, 20, 21, 24, 27, 28 or 29 and up to 5 further conservative substitutions are carried out at any of these positions. In some embodiments 1, 2, or 3 amino acid modifications are carried out within amino acids at positions 1-16, and 1, 2 or 3 amino acid modifications are carried out within amino acids at positions 17-26. In some embodiments, such glucagon related analog peptides retain at least 22, 23, 24, 25, 26, 27 or 28 of the naturally occurring amino acids at the corresponding positions in native glucagon (e.g. have 1-7, 1-5 or 1-3 modifications relative to naturally occurring glucagon).

DPP-IV Resistance

In some embodiments, the glucagon related analog peptide comprises a modification at position 1 or 2 to reduce susceptibility to cleavage by dipeptidyl peptidase IV. More particularly, in some embodiments, position 1 of a glucagon related analog peptide (e.g., selected from those in FIG. 10) is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the glucagon related analog peptide is substituted with an amino acid selected from the group consisting of D-serine, D-alanine, valine, glycine, N-methyl serine, and aminoisobutyric acid.

Hydrophilic Moieties

In one embodiment, the glucagon related analog peptide, (e.g., a Class 1 glucagon related analog peptide, Class 2 glucagon related analog peptide, Class 3 glucagon related analog peptide, Class 4 glucagon related analog peptides or Class 5 glucagon related analog peptide) is attached (covalently bonded) to a hydrophilic moiety. Hydrophilic moieties can be attached to the glucagon related analog peptide under any suitable conditions used to react a protein with an activated polymer molecule. Any means known in the art can be used, including via acylation, reductive alkylation, Michael addition, thiol alkylation or other chemoselective conjugation/ligation methods through a reactive group on the PEG moiety (e.g., an aldehyde, amino, ester, thiol, α-haloacetyl, maleimido or hydrazino group) to a reactive group on the target compound (e.g., an aldehyde, amino, ester, thiol, α-haloacetyl, maleimido or hydrazino group). Activating groups which can be used to link the water soluble polymer to one or more proteins include without limitation sulfone, maleimide, sulfhydryl, thiol, triflate, tresylate, azidirine, oxirane and 5-pyridyl. If attached to the peptide by reductive alkylation, the polymer selected should have a single reactive aldehyde so that the degree of polymerization is controlled. See, for example, Kinstler et al., *Adv. Drug. Delivery Rev.* 54: 477-485 (2002); Roberts et al., *Adv. Drug Delivery Rev.* 54: 459-476 (2002); and Zalipsky et al., *Adv. Drug Delivery Rev.* 16: 157-182 (1995).

Suitable hydrophilic moieties include polyethylene glycol (PEG), polypropylene glycol, polyoxyethylated polyols (e.g., POG), polyoxyethylated sorbitol, polyoxyethylated glucose, polyoxyethylated glycerol (POG), polyoxyalkylenes, polyethylene glycol propionaldehyde, copolymers of ethylene glycol/propylene glycol, monomethoxy-polyethylene glycol, mono-(C1-C10) alkoxy- or aryloxy-polyethylene glycol, carboxymethylcellulose, polyacetals, polyvinyl alcohol (PVA), polyvinyl pyrrolidone, poly-1,3-dioxolane, poly-1,3,6-trioxane, ethylene/maleic anhydride copolymer, poly (.beta.-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, colonic acids or other polysaccharide polymers, Ficoll or dextran and mixtures thereof. Dextrans are polysaccharide polymers of glucose subunits, predominantly linked by α1-6 linkages. Dextran is available in many molecular weight ranges, e.g., about 1 kD to about 100 kD, or from about 5, 10, 15 or 20 kD to about 20, 30, 40, 50, 60, 70, 80 or 90 kD.

In one embodiment the hydrophilic moiety is a polyethylene glycol (PEG) chain or other water soluble polymer that is covalently linked to the side chain of an amino acid residue at one or more of positions 16, 17, 21, 24, 29, 40 of said glucagon related analog peptide, within a C-terminal extension, or at the C-terminal amino acid. In some embodiments, the native amino acid at that position is substituted with an amino acid having a side chain suitable for crosslinking with hydrophilic moieties, to facilitate linkage of the hydrophilic moiety to the peptide. Exemplary amino acids include Cys, Lys, Orn, homo-Cys, or acetyl phenylalanine (Ac-Phe). In other embodiments, an amino acid modified to comprise a hydrophilic group is added to the peptide at the C-terminus.

The hydrophilic moiety, e.g., polyethylene glycol chain in accordance with some embodiments has a molecular weight selected from the range of about 500 to about 40,000 Daltons. In one embodiment the polyethylene glycol chain has a molecular weight selected from the range of about 500 to about 5,000 Daltons, or about 1,000 to about 5,000 Daltons. In another embodiment the hydrophilic moiety, e.g., polyethylene glycol chain, has a molecular weight of about 10,000 to about 20,000 Daltons. In yet other exemplary embodiments the hydrophilic moiety, e.g. polyethylene glycol chain, has a molecular weight of about 20,000 to about 40,000 Daltons.

Linear or branched polymers are contemplated. Resulting preparations of conjugates may be essentially monodisperse or polydisperse, and may have about 0.5, 0.7, 1, 1.2, 1.5 or 2 polymer moieties per peptide.

Acylation

In one embodiment, the glucagon related analog peptide (e.g. a Class 1 glucagon related analog peptide, Class 2 glucagon related analog peptide, Class 3 glucagon related analog peptide, Class 4 glucagon related analog peptide, Class 4 glucagon related analog peptides or Class 5 glucagon related analog peptide), is modified to comprise an acyl group. Acylation can be carried out at any position within the glucagon related analog peptide, including any of positions 1-29, a position within a C-terminal extension, or the C-terminal amino acid, provided that the activity exhibited by the non-acylated glucagon related analog peptide is retained upon acylation. For example, if the unacylated peptide has glucagon agonist activity, then the acylated peptide retains the glucagon agonist activity. Also for example, if the unacylated peptide has glucagon antagonist activity, then the acylated peptide retains the glucagon antagonist activity. For instance, if the unacylated peptide has GLP-1 agonist activity, then the acylated peptide retains GLP-1 agonist activity. Nonlimiting examples include acylation at positions 5, 7, 10, 11, 12, 13, 14, 16, 17, 18, 19, 20, 21, 24, 27, 28, or 29 (according to the amino acid numbering of wild type glucagon). The acyl group can be covalently linked directly to an amino acid of the glucagon related analog peptide, or indirectly to an amino acid of the glucagon related analog peptide via a spacer, wherein the spacer is positioned between the amino acid of the glucagon related analog peptide and the acyl group. Glucagon related analog peptides may be acylated at the same amino acid position where a hydrophilic moiety is linked, or at a different amino acid position. Nonlimiting examples include acylation at position 10 (according to the amino acid numbering of the wild type glucagon) and pegylation at one or more positions in the C-terminal portion of the glucagon peptide, e.g., position 24, 28 or 29 (according to the amino acid numbering of the wild type glucagon), within a C-terminal extension, or at the C-terminus (e.g., through adding a C-terminal Cys).

In a specific aspect of the invention, the glucagon related analog peptide is modified to comprise an acyl group by direct acylation of an amine, hydroxyl, or thiol of a side chain of an amino acid of the glucagon related analog peptide. In some embodiments, the glucagon related analog peptide is directly acylated through the side chain amine, hydroxyl, or thiol of an amino acid. In some embodiments, acylation is at position 10, 20, 24, or 29 (according to the amino acid numbering of the wild type glucagon). In this regard, the acylated glucagon related analog peptide can comprise the amino acid sequence of SEQ ID NO: 612, or a modified amino acid sequence thereof comprising one or more of the amino acid modifications described herein, with at least one of the amino acids at positions 10, 20, 24, and 29 (according to the amino acid numbering of the wild type glucagon) modified to any amino acid comprising a side chain amine, hydroxyl, or thiol. In some specific embodiments of the invention, the direct acylation of the glucagon related analog peptide occurs through the side chain amine, hydroxyl, or thiol of the amino acid at position 10 (according to the amino acid numbering of the wild type glucagon).

In some embodiments, the amino acid comprising a side chain amine is an amino acid of Formula VIII:

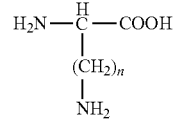

[Formula VIII]

wherein n = 1 to 4

In some exemplary embodiments, the amino acid of Formula VIII, is the amino acid wherein n is 4 (Lys) or n is 3 (Orn).

In other embodiments, the amino acid comprising a side chain hydroxyl is an amino acid of Formula IX:

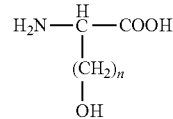

[Formula IX]

wherein n = 1 to 4

In some exemplary embodiments, the amino acid of Formula IX is the amino acid wherein n is 1 (Ser).

In yet other embodiments, the amino acid comprising a side chain thiol is an amino acid of Formula X:

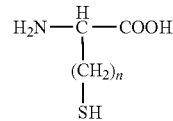

wherein n = 1 to 4

In some exemplary embodiments, the amino acid of Formula X is the amino acid wherein n is 1 (Cys).

In one embodiment of the invention, the acylated glucagon related analog peptide comprises a spacer between the peptide and the acyl group. In some embodiments, the glucagon related analog peptide is covalently bound to the spacer, which is covalently bound to the acyl group. In some exemplary embodiments, the glucagon related analog peptide is modified to comprise an acyl group by acylation of an amine, hydroxyl, or thiol of a spacer, which spacer is attached to a side chain of an amino acid at position 10, 20, 24, or 29 (according to the amino acid numbering of the wild type glucagon), or at the C-terminal amino acid of the glucagon related analog peptide. The amino acid to which the spacer is attached can be any amino acid comprising a moiety which permits linkage to the spacer. For example, an amino acid comprising a side chain NH2, —OH, or —COOH (e.g., Lys, Orn, Ser, Asp, or Glu) is suitable. In this respect, the acylated glucagon related analog peptide can comprise the amino acid sequence of SEQ ID NO: 612, or a modified amino acid sequence thereof comprising one or more of the amino acid modifications described herein, with at least one of the amino acids at positions 10, 20, 24, and 29 (according to the amino acid numbering of the wild type glucagon) modified to any amino acid comprising a side chain amine, hydroxyl, or carboxylate.

In some embodiments, the spacer is an amino acid comprising a side chain amine, hydroxyl, or thiol, or a dipeptide or tripeptide comprising an amino acid comprising a side chain amine, hydroxyl, or thiol.

When acylation occurs through an amine group of a spacer the acylation can occur through the alpha amine of the amino acid or a side chain amine. In the instance in which the alpha amine is acylated, the spacer amino acid can be any amino acid. For example, the spacer amino acid can be a hydrophobic amino acid, e.g., Gly, Ala, Val, Leu, Ile, Trp, Met, Phe, Tyr. Alternatively, the spacer amino acid can be an acidic residue, e.g., Asp and Glu. In the instance in which the side chain amine of the spacer amino acid is acylated, the spacer amino acid is an amino acid comprising a side chain amine, e.g., an amino acid of Formula VIII (e.g., Lys or Orn). In this instance, it is possible for both the alpha amine and the side chain amine of the spacer amino acid to be acylated, such that the glucagon peptide is diacylated. Embodiments of the invention include such diacylated molecules.

When acylation occurs through a hydroxyl group of a spacer, the amino acid or one of the amino acids of the dipeptide or tripeptide can be an amino acid of Formula IX. In a specific exemplary embodiment, the amino acid is Ser.

When acylation occurs through a thiol group of a spacer, the amino acid or one of the amino acids of the dipeptide or tripeptide can be an amino acid of Formula X. In a specific exemplary embodiment, the amino acid is Cys.

In one embodiment, the spacer comprises a hydrophilic bifunctional spacer. In a specific embodiment, the spacer comprises an amino poly(alkyloxy)carboxylate. In this regard, the spacer can comprise, for example, NH$_2$(CH$_2$CH$_2$O)$_n$(CH$_2$)$_m$COOH, wherein m is any integer from 1 to 6 and n is any integer from 2 to 12, such as, e.g., 8-amino-3,6-dioxaoctanoic acid, which is commercially available from Peptides International, Inc. (Louisville, Ky.).

Suitable methods of peptide acylation via amines, hydroxyls, and thiols are known in the art. See, for example, Miller, *Biochem Biophys Res Commun* 218: 377-382 (1996); Shimohigashi and Stammer, *Int J Pept Protein Res* 19: 54-62 (1982); and Previero et al., *Biochim Biophys Acta* 263: 7-13 (1972) (for methods of acylating through a hydroxyl); and San and Silvius, *J Pept Res* 66: 169-180 (2005) (for methods of acylating through a thiol); *Bioconjugate Chem*. "Chemical Modifications of Proteins: History and Applications" pages 1, 2-12 (1990); Hashimoto et al., *Pharmacuetical Res*. "Synthesis of Palmitoyl Derivatives of Insulin and their Biological Activity" Vol. 6, No: 2 pp. 171-176 (1989).

The acyl group of the acylated glucagon related analog peptide can be of any size, e.g., any length carbon chain, and can be linear or branched. In some specific embodiments of the invention, the acyl group is a C4 to C30 fatty acid. For example, the acyl group can be any of a C4 fatty acid, C6 fatty acid, C8 fatty acid, C10 fatty acid, C12 fatty acid, C14 fatty acid, C16 fatty acid, C18 fatty acid, C20 fatty acid, C22 fatty acid, C24 fatty acid, C26 fatty acid, C28 fatty acid, or a C30 fatty acid. In some embodiments, the acyl group is a C8 to C20 fatty acid, e.g., a C14 fatty acid or a C16 fatty acid.

In an alternative embodiment, the acyl group is a bile acid. The bile acid can be any suitable bile acid, including, but not limited to, cholic acid, chenodeoxycholic acid, deoxycholic acid, lithocholic acid, taurocholic acid, glycocholic acid, and cholesterol acid.

The acylated glucagon related analog peptides described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In this regard, the acylated glucagon related analog peptide can comprise SEQ ID NO: 612, including any of the modifications described herein, in which at least one of the amino acids at position 10, 20, 24, and 29 (according to the amino acid numbering of the wild type glucagon) comprise an acyl group and at least one of the amino acids at position 16, 17, 21, 24, or 29 (according to the amino acid numbering of the wild type glucagon), a position within a C-terminal extension, or the C-terminal amino acid are modified to a Cys, Lys, Orn, homo-Cys, or Ac-Phe, and the side chain of the amino acid is covalently bonded to a hydrophilic moiety (e.g., PEG). In some embodiments, the acyl group is attached to position 10 (according to the amino acid numbering of the wild type glucagon), optionally via a spacer comprising Cys, Lys, Orn, homo-Cys, or Ac-Phe, and the hydrophilic moiety is incorporated at a Cys residue at position 24.

Alternatively, the acylated glucagon related analog peptide can comprise a spacer, wherein the spacer is both acylated and modified to comprise the hydrophilic moiety. Nonlimiting examples of suitable spacers include a spacer comprising one or more amino acids selected from the group consisting of Cys, Lys, Orn, homo-Cys, and Ac-Phe.

Alkylation

In accordance with one embodiment, the glucagon related analog peptide, e.g., a Class 1 glucagon related analog peptide, Class 2 glucagon related analog peptide, Class 3 glucagon related analog peptide, Class 4 glucagon peptide, or Class 5 glucagion related peptide, is modified to comprise an alkyl group which is attached to the glucagon related analog peptide via an ether, thioether, or amino linkage for purposes of prolonging half-life in circulation and/or delaying the onset of and/or extending the duration of action and/or improving resistance to proteases such as DPP-IV.

Alkylation can be carried out at any positions within the glucagon related analog peptide, including any of positions 1-29, a position within a C-terminal extension, or the C-terminal amino acid, provided that an agonist or antagonist activity of the glucagon related analog peptide with respect to glucagon, GLP-1 or other glucagon related analog peptide receptor is retained. In some embodiments, if the unalkylated peptide has glucagon agonist activity, then the alkylated peptide retains glucagon agonist activity is retained. In other embodiments, if the unalkylated peptide has glucagon antagonist activity, then the alkylated peptide retains glucagon antagonist activity. In some embodiments, if the unalkylated peptide has GLP-1 agonist activity, then the alkylated peptide retains GLP-1 agonist activity. Nonlimiting examples include alkylation at positions 5, 7, 10, 11, 12, 13, 14, 16, 17, 18, 19, 20, 21, 24, 27, 28, or 29 (according to the amino acid numbering of wild type glucagon). The alkyl group can be covalently linked directly to an amino acid of the glucagon related analog peptide, or indirectly to an amino acid of the glucagon related analog peptide via a spacer, wherein the spacer is positioned between the amino acid of the glucagon related analog peptide and the alkyl group. Glucagon related analog peptides may be alkylated at the same amino acid position where a hydrophilic moiety is linked, or at a different amino acid position. Nonlimiting examples include alkylation at position 10 (according to the amino acid numbering of wild type glucagon) and pegylation at one or more positions in the C-terminal portion of the glucagon related analog peptide, e.g., position 24, 28 or 29 (according to the amino acid numbering of wild type glucagon), within a C-terminal extension, or at the C-terminus (e.g., through adding a C-terminal Cys).

In a specific aspect of the invention, the glucagon related analog peptide is modified to comprise an alkyl group by direct alkylation of an amine, hydroxyl, or thiol of a side chain of an amino acid of the glucagon related analog peptide. In some embodiments, the glucagon related analog peptide is directly alkylated through the side chain amine, hydroxyl, or thiol of an amino acid. In some embodiments, alkylation is at position 10, 20, 24, or 29 (according to the amino acid numbering of wild type glucagon). In this regard, the alkylated glucagon related analog peptide can comprise the amino acid sequence of SEQ ID NO: 612, or a modified amino acid sequence thereof comprising one or more of the amino acid modifications described herein, with at least one of the amino acids at positions 10, 20, 24, and 29 (according to the amino acid numbering of wild type glucagon) modified to any amino acid comprising a side chain amine, hydroxyl, or thiol. In some specific embodiments of the invention, the direct alkylation of the glucagon related analog peptide occurs through the side chain amine, hydroxyl, or thiol of the amino acid at position 10 (according to the amino acid numbering of wild type glucagon).

In some embodiments, the amino acid comprising a side chain amine is an amino acid of Formula VIII. In some exemplary embodiments, the amino acid of Formula VIII, is the amino acid wherein n is 4 (Lys) or n is 3 (Orn).

In other embodiments, the amino acid comprising a side chain hydroxyl is an amino acid of Formula IX. In some exemplary embodiments, the amino acid of Formula IX is the amino acid wherein n is 1 (Ser).

In yet other embodiments, the amino acid comprising a side chain thiol is an amino acid of Formula X. In some exemplary embodiments, the amino acid of Formula X is the amino acid wherein n is 1 (Cys).

In one embodiment of the invention, the alkylated glucagon related analog peptide comprises a spacer between the peptide and the alkyl group. In some embodiments, the glucagon related analog peptide is covalently bound to the spacer, which is covalently bound to the alkyl group. In some exemplary embodiments, the glucagon related analog peptide is modified to comprise an alkyl group by alkylation of an amine, hydroxyl, or thiol of a spacer, which spacer is attached to a side chain of an amino acid at position 10, 20, 24, or 29 (according to the amino acid numbering of wild type glucagon) of the glucagon related analog peptide. The amino acid to which the spacer is attached can be any amino acid comprising a moiety which permits linkage to the spacer. For example, an amino acid comprising a side chain $NH_2$, —OH, or —COOH (e.g., Lys, Orn, Ser, Asp, or Glu) is suitable. In this respect, the alkylated glucagon related analog peptide can comprise the amino acid sequence of SEQ ID NO: 612, or a modified amino acid sequence thereof comprising one or more of the amino acid modifications described herein, with at least one of the amino acids at positions 10, 20, 24, and 29 (according to the amino acid numbering of wild type glucagon) modified to any amino acid comprising a side chain amine, hydroxyl, or carboxylate.

In some embodiments, the spacer is an amino acid comprising a side chain amine, hydroxyl, or thiol or a dipeptide or tripeptide comprising an amino acid comprising a side chain amine, hydroxyl, or thiol.

When alkylation occurs through an amine group of a spacer the alkylation can occur through the alpha amine of the amino acid or a side chain amine. In the instance in which the alpha amine is alkylated, the spacer amino acid can be any amino acid. For example, the spacer amino acid can be a hydrophobic amino acid, e.g., Gly, Ala, Val, Leu, Ile, Trp, Met, Phe, Tyr. Alternatively, the spacer amino acid can be an acidic residue, e.g., Asp and Glu. In the instance in which the side chain amine of the spacer amino acid is alkylated, the spacer amino acid is an amino acid comprising a side chain amine, e.g., an amino acid of Formula VIII (e.g., Lys or Orn). In this instance, it is possible for both the alpha amine and the side chain amine of the spacer amino acid to be alkylated, such that the glucagon peptide is dialkylated. Embodiments of the invention include such dialkylated molecules.

When alkylation occurs through a hydroxyl group of a spacer, the amino acid or one of the amino acids of the spacer can be an amino acid of Formula IX. In a specific exemplary embodiment, the amino acid is Ser.

When alkylation occurs through a thiol group of spacer, the amino acid or one of the amino acids of the spacer can be an amino acid of Formula X. In a specific exemplary embodiment, the amino acid is Cys.

In one embodiment, the spacer comprises a hydrophilic bifunctional spacer. In a specific embodiment, the spacer comprises an amino poly(alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.).

Suitable methods of peptide alkylation via amines, hydroxyls, and thiols are known in the art. For example, a Williamson ether synthesis can be used to form an ether linkage between the glucagon related analog peptide and the alkyl group. Also, a nucleophilic substitution reaction of the peptide with an alkyl halide can result in any of an ether, thioether, or amino linkage.

The alkyl group of the alkylated glucagon related analog peptide can be of any size, e.g., any length carbon chain, and can be linear or branched. In some embodiments of the invention, the alkyl group is a C4 to C30 alkyl. For example, the alkyl group can be any of a C4 alkyl, C6 alkyl, C8 alkyl, C10 alkyl, C12 alkyl, C14 alkyl, C16 alkyl, C18 alkyl, C20 alkyl, C22 alkyl, C24 alkyl, C26 alkyl, C28 alkyl, or a C30 alkyl. In some embodiments, the alkyl group is a C8 to C20 alkyl, e.g., a C14 alkyl or a C16 alkyl.

In some specific embodiments, the alkyl group comprises a steroid moiety of a bile acid, e.g., cholic acid, chenodeoxycholic acid, deoxycholic acid, lithocholic acid, taurocholic acid, glycocholic acid, and cholesterol acid.

The alkylated glucagon related analog peptides described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In this regard, the alkylated glucagon related analog peptide can comprise SEQ ID NO: 612, or a modified amino acid sequence thereof comprising one or more of the amino acid modifications described herein, in which at least one of the amino acids at position 10, 20, 24, and 29 (according to the amino acid numbering of wild type glucagon) comprise an alkyl group and at least one of the amino acids at position 16, 17, 21, 24, and 29, a position within a C-terminal extension or the C-terminal amino acid are modified to a Cys, Lys, Orn, homo-Cys, or Ac-Phe, and the side chain of the amino acid is covalently bonded to a hydrophilic moiety (e.g., PEG). In some embodiments, the alkyl group is attached to position 10 (according to the amino acid numbering of wild type glucagon), optionally via a spacer comprising Cys, Lys, Orn, homo-Cys, or Ac-Phe, and the hydrophilic moiety is incorporated at a Cys residue at position 24.

Alternatively, the alkylated glucagon related analog peptide can comprise a spacer, wherein the spacer is both alkylated and modified to comprise the hydrophilic moiety. Non-limiting examples of suitable spacers include a spacer comprising one or more amino acids selected from the group consisting of Cys, Lys, Orn, homo-Cys, and Ac-Phe.

Stabilization of the Alpha-Helix Structure

In some embodiments, an intramolecular bridge is formed between two amino acid side chains to stabilize the three dimensional structure of the carboxy terminal portion (e.g., amino acids 12-29 (according to the amino acid numbering of wild type glucagon)) of the glucagon related analog peptide. The two amino acid side chains can be linked to one another through hydrogen-bonding, ionic interactions, such as the formation of salt bridges, or by covalent bonds.

In some embodiments, the intramolecular bridge is formed between two amino acids that are 3 amino acids apart, e.g., amino acids at positions i and i+4, wherein i is any integer between 12 and 25 (e.g., 12, 13, 14, 15, 16, 17, 18, 19, 20, 21, 22, 23, 24, and 25) according to the amino acid numbering of wild type glucagon. More particularly, the side chains of the amino acid pairs 12 and 16, 16 and 20, 20 and 24 or 24 and 28 (amino acid pairs in which i=12, 16, 20, or 24) according to the amino acid numbering of wild type glucagon are linked to one another and thus stabilize the glucagon alpha helix. Alternatively, i can be 17.

In some specific embodiments, wherein the amino acids at positions i and i+4 are joined by an intramolecular bridge, the size of the linker is about 8 atoms, or about 7-9 atoms.

In other embodiments, the intramolecular bridge is formed between two amino acids that are two amino acids apart, e.g., amino acids at positions j and j+3, wherein j is any integer between 12 and 26 (e.g., 12, 13, 14, 15, 16, 17, 18, 19, 20, 21, 22, 23, 24, 25, and 26) according to the amino acid numbering of wild type glucagon. In some specific embodiments, j is 17.

In some specific embodiments, wherein amino acids at positions j and j+3 are joined by an intramolecular bridge, the size of the linker is about 6 atoms, or about 5 to 7 atoms.

In yet other embodiments, the intramolecular bridge is formed between two amino acids that are 6 amino acids apart, e.g., amino acids at positions k and k+7, wherein k is any integer between 12 and 22 (e.g., 12, 13, 14, 15, 16, 17, 18, 19, 20, 21, and 22) according to the amino acid numbering of wild type glucagon. In some specific embodiments, k is 12, 13, or 17. In an exemplary embodiment, k is 17.

Examples of amino acid pairings that are capable of covalently bonding to form a six-atom linking bridge include Orn and Asp, Glu and an amino acid of Formula VIII, wherein n is 2, and homoglutamic acid and an amino acid of Formula VIII, wherein n is 1, wherein Formula VIII is:

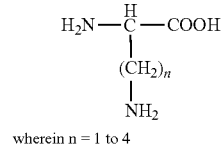

[Formula VIII]

wherein n = 1 to 4

Examples of amino acid pairing that are capable of covalently bonding to form a seven-atom linking bridge include Orn-Glu (lactam ring); Lys-Asp (lactam); or Homoser-Homoglu (lactone). Examples of amino acid pairings that may form an eight-atom linker include Lys-Glu (lactam); Homolys-Asp (lactam); Orn-Homoglu (lactam); 4-aminoPhe-Asp (lactam); or Tyr-Asp (lactone). Examples of amino acid pairings that may form a nine-atom linker include Homolys-Glu (lactam); Lys-Homoglu (lactam); 4-aminoPhe-Glu (lactam); or Tyr-Glu (lactone). Any of the side chains on these amino acids may additionally be substituted with additional chemical groups, so long as the three-dimensional structure of the alpha-helix is not disrupted. One of ordinary skill in the art can envision alternative pairings or alternative amino acid analogs, including chemically modified derivatives, that would create a stabilizing structure of similar size and desired effect. For example, a homocysteine-homocysteine disulfide bridge is 6 atoms in length and may be further modified to provide the desired effect. Even without covalent linkage, the amino acid pairings described above or similar pairings that one of ordinary skill in the art can envision may also provide added stability to the alpha-helix through non-covalent bonds, for example, through formation of salt bridges or hydrogen-bonding interactions.

The size of a lactam ring can vary depending on the length of the amino acid side chains, and in one embodiment the lactam is formed by linking the side chains of a lysine amino acid to a glutamic acid side chain. Further exemplary embodiments (according to the amino acid numbering of wild type glucagon) include the following pairings, optionally with a lactam bridge: Glu at position 12 with Lys at position 16; native Lys at position 12 with Glu at position 16; Glu at position 16 with Lys at position 20; Lys at position 16 with Glu at position 20; Glu at position 20 with Lys at position 24; Lys at position 20 with Glu at position 24; Glu at position 24 with Lys at position 28; Lys at position 24 with Glu at position 28. Alternatively, the order of the amide bond in the lactam ring can be reversed (e.g., a lactam ring can be formed between the side chains of a Lys12 and a Glu16 or alternatively between a Glu 12 and a Lys16).

Intramolecular bridges other than a lactam bridge can be used to stabilize the alpha helix of the glucagon related analog peptides. In one embodiment, the intramolecular bridge is a hydrophobic bridge. In this instance, the intramolecular bridge optionally is between the side chains of two amino acids that are part of the hydrophobic face of the alpha helix of the glucagon related analog peptide. For example, one of the amino acids joined by the hydrophobic bridge can be the amino acid at position 10, 14, and 18 (according to the amino acid numbering of wild type glucagon).

In one specific aspect, olefin metathesis is used to cross-link one or two turns of the alpha helix of the glucagon related analog peptide using an all-hydrocarbon cross-linking system. The glucagon related analog peptide in this instance can comprise α-methylated amino acids bearing olefinic side chains of varying length and configured with either R or S stereochemistry at the i and i+4 or i+7 positions. For example, the olefinic side can comprise $(CH_2)n$, wherein n is any integer between 1 to 6. In one embodiment, n is 3 for a cross-link length of 8 atoms. Suitable methods of forming such intramolecular bridges are described in the art. See, for example, Schafmeister et al., *J. Am. Chem. Soc.* 122: 5891-5892 (2000) and Walensky et al., *Science* 305: 1466-1470 (2004). Alternatively, the glucagon peptide can comprise O-allyl Ser residues located on adjacent helical turns, which are bridged together via ruthenium-catalyzed ring closing metathesis. Such procedures of cross-linking are described in, for example, Blackwell et al., *Angew, Chem., Int. Ed.* 37: 3281-3284 (1998).

In another specific aspect, use of the unnatural thio-dialanine amino acid, lanthionine, which has been widely adopted as a peptidomimetic of cystine, is used to cross-link one turn of the alpha helix. Suitable methods of lanthionine-based cyclization are known in the art. See, for instance, Matteucci et al., *Tetrahedron Letters* 45: 1399-1401 (2004); Mayer et al., *J. Peptide Res.* 51: 432-436 (1998); Polinsky et al., *J. Med. Chem.* 35: 4185-4194 (1992); Osapay et al., *J. Med. Chem.* 40: 2241-2251 (1997); Fukase et al., *Bull. Chem. Soc. Jpn.* 65: 2227-2240 (1992); Harpp et al., *J. Org. Chem.* 36: 73-80 (1971); Goodman and Shao, *Pure Appl. Chem.* 68: 1303-1308 (1996); and Osapay and Goodman, *J. Chem. Soc. Chem. Commun.* 1599-1600 (1993).

In some embodiments, $\alpha,\omega$-diaminoalkane tethers, e.g., 1,4-diaminopropane and 1,5-diaminopentane) between two Glu residues at positions i and i+7 are used to stabilize the alpha helix of the glucagon peptide. Such tethers lead to the formation of a bridge 9-atoms or more in length, depending on the length of the diaminoalkane tether. Suitable methods of producing peptides cross-linked with such tethers are described in the art. See, for example, Phelan et al., *J. Am. Chem. Soc.* 119: 455-460 (1997).

In yet another embodiment of the invention, a disulfide bridge is used to cross-link one or two turns of the alpha helix of the glucagon related analog peptide. Alternatively, a modified disulfide bridge in which one or both sulfur atoms are replaced by a methylene group resulting in an isosteric macrocyclization is used to stabilize the alpha helix of the glucagon related analog peptide. Suitable methods of modifying peptides with disulfide bridges or sulfur-based cyclization are described in, for example, Jackson et al., *J. Am. Chem. Soc.* 113: 9391-9392 (1991) and Rudinger and Jost, *Experientia* 20: 570-571 (1964).

In yet another embodiment, the alpha helix of the glucagon related analog peptide is stabilized via the binding of metal atom by two His residues or a His and Cys pair positioned at i and i+4. The metal atom can be, for example, Ru(III), Cu(II), Zn(II), or Cd(II). Such methods of metal binding-based alpha helix stabilization are known in the art. See, for example, Andrews and Tabor, *Tetrahedron* 55: 11711-11743 (1999); Ghadiri et al., *J. Am. Chem. Soc.* 112: 1630-1632 (1990); and Ghadiri et al., *J. Am. Chem. Soc.* 119: 9063-9064 (1997).

The alpha helix of the glucagon related analog peptide can alternatively be stabilized through other means of peptide cyclizing, which means are reviewed in Davies, *J. Peptide. Sci.* 9: 471-501 (2003). The alpha helix can be stabilized via the formation of an amide bridge, thioether bridge, thioester bridge, urea bridge, carbamate bridge, sulfonamide bridge, and the like. For example, a thioester bridge can be formed between the C-terminus and the side chain of a Cys residue. Alternatively, a thioester can be formed via side chains of amino acids having a thiol (Cys) and a carboxylic acid (e.g., Asp, Glu). In another method, a cross-linking agent, such as a dicarboxylic acid, e.g. suberic acid (octanedioic acid), etc. can introduce a link between two functional groups of an amino acid side chain, such as a free amino, hydroxyl, thiol group, and combinations thereof.

In accordance with one embodiment, the alpha helix of the glucagon related analog peptide is stabilized through the incorporation of hydrophobic amino acids at positions i and i+4. For instance, i can be Tyr and i+4 can be either Val or Leu; i can be Phe and i+4 can be Cys or Met; I can be Cys and i+4 can be Met; or i can be Phe and i+4 can be Ile. It should be understood that, for purposes herein, the above amino acid pairings can be reversed, such that the indicated amino acid at position i could alternatively be located at i+4, while the i+4 amino acid can be located at the i position.

In accordance with other embodiments of the invention, wherein glucagon related analog peptide is a peptide having glucagon agonist activity, GIP agonist activity, glucagon antagonist and GLP-1 activity, the alpha helix is stabilized through incorporation (either by amino acid substitution or insertion) of one or more alpha helix-stabilizing amino acids at the C-terminal portion of the glucagon related analog peptide (around amino acids 12-29 according to the numbering of the amino acid numbering of wild type glucagon). In a specific embodiment, the alpha helix-stabilizing amino acid is an $\alpha,\alpha$-disubstituted amino acid, including, but not limited to any of amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In some embodiments, one, two, three, four or more of positions 16, 17, 18, 19, 20, 21, 24 or 29 of the glucagon related analog peptide is substituted with an $\alpha,\alpha$-disubstituted amino acid. In a specific embodiment, one, two, three or all of positions 16, 20, 21, and 24 are substituted with AIB.

Conjugates

The present disclosure also encompasses conjugates in which a glucagon related analog peptide (e.g. a Class 1 glucagon related analog peptide, Class 2 glucagon related analog peptide, Class 3 glucagon related analog peptide, Class 4 glucagon related analog peptide, or Class 5 glucagon related analog peptide), is linked, optionally via covalent bonding and optionally via a linker, to a conjugate moiety. Linkage can be accomplished by covalent chemical bonds, physical forces such electrostatic, hydrogen, ionic, van der Waals, or hydrophobic or hydrophilic interactions. A variety of non-covalent coupling systems may be used, including biotin-avidin, ligand/receptor, enzyme/substrate, nucleic acid/nucleic acid binding protein, lipid/lipid binding protein, cellular adhesion molecule partners; or any binding partners or fragments thereof which have affinity for each other.

The glucagon related analog peptide can be linked to conjugate moieties via direct covalent linkage by reacting targeted amino acid residues of the peptide with an organic derivatizing agent that is capable of reacting with selected side chains or the N- or C-terminal residues of these targeted amino acids. Reactive groups on the peptide or conjugate moiety include, e.g., an aldehyde, amino, ester, thiol, $\alpha$-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, the conjugate moieties can be linked to the peptide indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, alpha-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino-terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high $pK_a$ of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Other modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)), deamidation of asparagine or glutamine, acetylation of the N-terminal amine, and/or amidation or esterification of the C-terminal carboxylic acid group.

Another type of covalent modification involves chemically or enzymatically coupling glycosides to the peptide. Sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of tyrosine, or tryptophan, or (f) the amide group of glutamine. These methods are described in WO87/05330 published 11 Sep. 1987, and in Aplin and Wriston, CRC Crit. Rev. Biochem., pp. 259-306 (1981).

Exemplary conjugate moieties that can be linked to any of the glucagon related analog peptides described herein include but are not limited to a heterologous peptide or polypeptide (including for example, a plasma protein), a targeting agent, an immunoglobulin or portion thereof (e.g. variable region, CDR, or Fc region), a diagnostic label such as a radioisotope, fluorophore or enzymatic label, a polymer including water soluble polymers, or other therapeutic or diagnostic agents. In one embodiment a conjugate is provided comprising a glucagon related analog peptide of the present invention and a plasma protein, wherein the plasma protein is selected from the group consisting of albumin, transferin, fibrinogen and globulins. In one embodiment the plasma protein moiety of the conjugate is albumin or transferin. In some embodiments, the linker comprises a chain of atoms from 1 to about 60, or 1 to 30 atoms or longer, 2 to 5 atoms, 2 to 10 atoms, 5 to 10 atoms, or 10 to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, the linker provides a functional group that is subject to cleavage by an enzyme or other catalyst or hydrolytic conditions found in the target tissue or organ or cell. In some embodiments, the length of the linker is long enough to reduce the potential for steric hindrance. If the linker is a covalent bond or a peptidyl bond and the conjugate is a polypeptide, the entire conjugate can be a fusion protein. Such peptidyl linkers may be any length. Exemplary linkers are from about 1 to 50 amino acids in length, 5 to 50, 3 to 5, 5 to 10, 5 to 15, or 10 to 30 amino acids in length. Such fusion proteins may alternatively be produced by recombinant genetic engineering methods known to one of ordinary skill in the art.

As noted above, in some embodiments, the glucagon related analog peptides are conjugated, e.g., fused to an immunoglobulin or portion thereof (e.g. variable region, CDR, or Fc region). Known types of immunoglobulins (Ig) include IgG, IgA, IgE, IgD or IgM. The Fc region is a C-terminal region of an Ig heavy chain, which is responsible for binding to Fc receptors that carry out activities such as recycling (which results in prolonged half-life), antibody dependent cell-mediated cytotoxicity (ADCC), and complement dependent cytotoxicity (CDC).

For example, according to some definitions the human IgG heavy chain Fc region stretches from Cys226 to the C-terminus of the heavy chain. The "hinge region" generally extends from Glu216 to Pro230 of human IgG1 (hinge regions of other IgG isotypes may be aligned with the IgG1 sequence by aligning the cysteines involved in cysteine bonding). The Fc region of an IgG includes two constant domains, CH2 and CH3. The CH2 domain of a human IgG Fc region usually extends from amino acids 231 to amino acid 341. The CH3 domain of a human IgG Fc region usually extends from amino acids 342 to 447. References made to amino acid numbering of immunoglobulins or immunoglobulin fragments, or regions, are all based on Kabat et al. 1991, Sequences of Proteins of Immunological Interest, U.S. Department of Public Health, Bethesda, Md. In a related embodiment, the Fc region may comprise one or more native or modified constant regions from an immunoglobulin heavy chain, other than CH1, for example, the CH2 and CH3 regions of IgG and IgA, or the CH3 and CH4 regions of IgE.

Suitable conjugate moieties include portions of immunoglobulin sequence that include the FcRn binding site. FcRn, a salvage receptor, is responsible for recycling immunoglobulins and returning them to circulation in blood. The region of the Fc portion of IgG that binds to the FcRn receptor has been described based on X-ray crystallography (Burmeister et al. 1994, Nature 372:379). The major contact area of the Fc with the FcRn is near the junction of the CH2 and CH3 domains. Fc-FcRn contacts are all within a single Ig heavy chain. The major contact sites include amino acid residues 248, 250-257, 272, 285, 288, 290-291, 308-311, and 314 of the CH2 domain and amino acid residues 385-387, 428, and 433-436 of the CH3 domain.

Some conjugate moieties may or may not include FcγR binding site(s). FcγR are responsible for ADCC and CDC. Examples of positions within the Fc region that make a direct contact with FcγR are amino acids 234-239 (lower hinge region), amino acids 265-269 (B/C loop), amino acids 297-299 (C'/E loop), and amino acids 327-332 (F/G) loop (Sondermann et al., Nature 406: 267-273, 2000). The lower hinge region of IgE has also been implicated in the FcRI binding (Henry, et al., Biochemistry 36, 15568-15578, 1997). Residues involved in IgA receptor binding are described in Lewis et al., (J Immunol. 175:6694-701, 2005). Amino acid residues involved in IgE receptor binding are described in Sayers et al. (J Biol Chem. 279(34):35320-5, 2004).

Amino acid modifications may be made to the Fc region of an immunoglobulin. Such variant Fc regions comprise at least one amino acid modification in the CH3 domain of the Fc region (residues 342-447) and/or at least one amino acid modification in the CH2 domain of the Fc region (residues 231-341). Mutations believed to impart an increased affinity for FcRn include T256A, T307A, E380A, and N434A (Shields et al. 2001, J. Biol. Chem. 276:6591). Other mutations may reduce binding of the Fc region to FcγRI, FcγRIIA, FcγRIIB, and/or FcγRIIIA without significantly reducing affinity for FcRn. For example, substitution of the Asn at position 297 of the Fc region with Ala or another amino acid removes a highly conserved N-glycosylation site and may result in reduced immunogenicity with concomitant prolonged half-life of the Fc region, as well as reduced binding to FcγRs (Routledge et al. 1995, Transplantation 60:847; Friend et al. 1999, Transplantation 68:1632; Shields et al. 1995, J. Biol. Chem. 276:6591). Amino acid modifications at positions 233-236 of IgG1 have been made that reduce binding to FcγRs (Ward and Ghetie 1995, Therapeutic Immunology 2:77 and Armour et al. 1999, Eur. J. Immunol. 29:2613). Some exemplary amino acid substitutions are described in U.S. Pat. Nos. 7,355,008 and 7,381,408, each incorporated by reference herein in its entirety.

Fusion Peptides—C-Terminal Extension

In certain embodiments a glucagon related analog peptide may comprise a C-terminus or a C-terminal amino acid sequence including but not limited to: COOH, CONH$_2$, GPSSGAPPPS (SEQ ID NO: 624), GPSSGAPPPS-CONH$_2$ (SEQ ID NO: 723), a oxyntomodulin carboxy terminal extension, KRNRNNIA (SEQ ID NO: 625) or KGKKNDWKH-NITQ (SEQ ID NO: 662). For example, the terminal ten amino acids of Exendin-4 (i.e. the sequence of SEQ ID NO: 624 (GPSSGAPPPS)) are linked to the carboxy terminus of the Class 1 glucagon related analog peptide, Class 2 glucagon related analog peptide, Class 3 glucagon related analog peptide, Class 4 glucagon related analog peptide, or Class 5 glucagon related analog peptide of the present disclosure.

Another compound that induces weight loss is oxyntomodulin, a naturally occurring digestive hormone found in the small intestine (see Diabetes 2005; 54:2390-2395). Oxyntomodulin is a 37 amino acid peptide (SEQ ID NO: 661) that contains the 29 amino acid sequence of glucagon followed by an 8 amino acid carboxy terminal extension of SEQ ID NO: 625 (KRNRNNIA). Accordingly, in one embodiment prodrug derivatives of glucagon related analog peptides are provided that further comprise the carboxy terminal extension of the sequence of SEQ ID NO: 625 or a four amino acid extension having the sequence KRNR.

Methods for Making Glucagon Related Analog Peptides

The glucagon related analog peptides (and prodrugs) of this disclosed herein may be prepared by standard synthetic methods, recombinant DNA techniques, or any other methods of preparing peptides and fusion proteins. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

Classes of glucagon related analog peptides are described in detail below. With respect to each of the sections of disclosure concerning class 1, 2, 3, 4 and 5 glucagon related analog peptides modifications are described with respect to the glucagon related analog peptide portion of a prodrug compound detailed above. Thus, structural elements described with regard to a class of glucagon related analog peptides are structural elements of a bioactive peptide, polypeptide, or protein which is then further modified to generate a prodrug compound as described above.

Class 1 Glucagon Related Analog Peptides

In certain embodiments, the glucagon related analog peptide is a Class 1 glucagon related analog peptide, which is described herein and in International Patent Application Publication No. WO 2008/086086, published on Jul. 17, 2008, and U.S. Provisional Application No. 61/090,415, the contents of which are incorporated by reference in their entirety.

Activity

Class 1 glucagon peptides retain glucagon receptor activity relative to the native glucagon peptide (SEQ ID NO: 701). For example, the glucagon peptide can retain at least 10%, 20%, 30%, 40%, 50%, 60%, 70%, 75% activity, 80% activity, 85% activity, or 90% of the activity of native glucagon (calculated as the inverse ratio of EC50s for the glucagon peptide vs. glucagon, e.g., as measured by cAMP production using the assay generally described in Example 2). In one embodiment, the Class 1 glucagon related analog peptides have the same or greater activity (used synonymously with the term "potency" herein) than glucagon.

Any of the Class 1 glucagon related analog peptides described herein may exhibit an EC50 at the human glucagon receptor of about 100 nM, 75 nM, 50 nM, 40 nM, 30 nM, 20 nM, 10 nM, 5 nM, 1 nM or less when tested for cAMP induction in HEK293 cells over-expressing glucagon receptor, e.g. using the assay of Example 2. Typically pegylated peptides will exhibit a higher EC50 compared to the unpegylated peptide.

In some embodiments, the Class 1 glucagon related analog peptides exhibit less than about 5%, 4%, 3%, 2% or 1% of the activity of native GLP-1 at the GLP-1 receptor and/or a greater than about 5-fold, 10-fold, or 15-fold selectivity for glucagon receptor compared to GLP-1 receptor. For example, in some embodiments, the Class 1 glucagon related analog peptides exhibit less than 5% of the activity of native GLP-1 at the GLP-1 receptor and exhibit a greater than 5-fold selectivity for glucagon receptor compared to GLP-1 receptor.

Improved Solubility

Native glucagon exhibits poor solubility in aqueous solution, particularly at physiological pH, with a tendency to aggregate and precipitate over time. In contrast, the Class 1 glucagon related analog peptides in one embodiment exhibit at least 2-fold, 5-fold, or even higher solubility compared to native glucagon at a pH between 6 and 8, or between 6 and 9, for example, at pH 7 after 24 hours at 25° C.

Accordingly, in one embodiment, a Class 1 glucagon related analog peptide has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 701) to improve the peptide's solubility in aqueous solutions, particularly at a pH ranging from about 5.5 to about 8.0, while retaining the native peptide's biological activity.

For example, the solubility of any of the Class 1 glucagon related analog peptides described herein can be further improved by attaching a hydrophilic moiety to the peptide. Introduction of such groups also increases duration of action, e.g. as measured by a prolonged half-life in circulation. Hydrophilic moieties are further described herein.

Modification with Charged Residues

In one embodiment, solubility is improved by adding charge to the Class 1 glucagon related analog peptide by the substitution of native non-charged amino acids with charged amino acids selected from the group consisting of lysine, arginine, histidine, aspartic acid and glutamic acid, or by the addition of charged amino acids to the amino or carboxy terminus of the peptide.

In accordance with one embodiment, the Class 1 glucagon related analog peptide has improved solubility due to the fact that the peptide is modified by amino acid substitutions and/or additions that introduce a charged amino acid into the C-terminal portion of the peptide, and in one embodiment at a position C-terminal to position 27 of SEQ ID NO: 701. Optionally, one, two or three charged amino acids may be introduced within the C-terminal portion, and in one embodiment C-terminal to position 27. In accordance with one embodiment, the native amino acid(s) at positions 28 and/or 29 are substituted with a charged amino acid, and/or one to three charged amino acids are added to the C-terminus of the peptide, e.g. after position 27, 28 or 29. In exemplary embodiments, one, two, three or all of the charged amino acids are negatively charged. In other embodiments, one, two, three or all of the charged amino acids are positively charged.

In specific exemplary embodiments, the Class 1 glucagon related analog peptide may comprise any one or two of the following modifications: substitution of N28 with E; substitution of N28 with D; substitution of T29 with D; substitution of T29 with E; insertion of E after position 27, 28 or 29; insertion of D after position 27, 28 or 29. For example, D28E29, E28E29, E29E30, E28E30, D28E30.

In accordance with one exemplary embodiment, the Class 1 glucagon related analog peptide comprises an amino acid sequence of SEQ ID NO: 711, or an analog thereof that contains 1 to 3 further amino acid modifications (described herein in reference to glucagon agonists) relative to native glucagon, or a glucagon agonist analog thereof. SEQ ID NO: 711 represents a modified Class 1 glucagon related analog peptide, wherein the asparagine residue at position 28 of the native protein has been substituted with an aspartic acid. In another exemplary embodiment the Class 1 glucagon related analog peptide comprises an amino acid sequence of SEQ ID NO: 738, wherein the asparagine residue at position 28 of the native protein has been substituted with glutamic acid. Other exemplary embodiments include Class 1 glucagon related analog peptides of SEQ ID NOS: 724, 725, 726, 733, 735, 736 and 737.

Substituting the normally occurring amino acid at position 28 and/or 29 with charged amino acids, and/or the addition of one to two charged amino acids at the carboxy terminus of the Class 1 glucagon related analog peptide, enhances the solubility and stability of the glucagon peptides in aqueous solutions at physiologically relevant pHs (i.e., a pH of about 6.5 to about 7.5) by at least 5-fold and by as much as 30-fold. Accordingly, Class 1 glucagon peptides of one embodiment retain glucagon activity and exhibit at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

Additional modifications, e.g. conservative substitutions, which modifications are further described herein, may be made to the Class 1 glucagon related analog peptide that still allow it to retain glucagon activity.

Improved Stability

Any of the Class 1 glucagon peptides may additionally exhibit improved stability and/or reduced degradation, for example, retaining at least 95% of the original peptide after 24 hours at 25° C. Any of the Class 1 glucagon related analog peptides disclosed herein may additionally exhibit improved stability at a pH within the range of 5.5 to 8, for example, retaining at least 75%, 80%, 90%, 95%, 96%, 97%, 98% or 99% of the original peptide after 24 hours at 25° C. The Class 1 glucagon related analog peptides may include additional modifications that alter its pharmaceutical properties, e.g. increased potency, prolonged half-life in circulation, increased shelf-life, reduced precipitation or aggregation, and/or reduced degradation, e.g., reduced occurrence of cleavage or chemical modification after storage.

In yet further exemplary embodiments, any of the foregoing Class 1 glucagon related analog peptides can be further modified to improve stability by modifying the amino acid at position 15 of SEQ ID NO: 701 to reduce degradation of the peptide over time, especially in acidic or alkaline buffers. In exemplary embodiments, Asp at position 15 is substituted with a Glu, homo-Glu, cysteic acid, or homo-cysteic acid.

Alternatively, any of the Class 1 glucagon related analog peptides described herein can be further modified to improve stability by modifying the amino acid at position 16 of SEQ ID NO: 701. In exemplary embodiments, Ser at position 16 is substituted with Thr or AIB, or any of the amino acids substitutions described herein with regard to Class 1 glucagon related analog peptides which enhance potency at the glucagon receptor. Such modifications reduce cleavage of the peptide bond between Asp15-Ser16.

In some embodiments, any of the Class 1 glucagon related analog peptides described herein can be further modified to reduce degradation at various amino acid positions by modifying any one, two, three, or all four of positions 20, 21, 24, or 27. Exemplary embodiments include substitution of Gln at position 20 with Ala or AIB, substitution of Asp at position 21 with Glu, substitution of Gln at position 24 with Ala or AIB, substitution of Met at position 27 with Leu or Nle. Removal or substitution of methionine reduces degradation due to oxidation of the methionine. Removal or substitution of Gln or Asn reduces degradation due to deamidation of Gln or Asn. Removal or substitution of Asp reduces degradation that occurs through dehydration of Asp to form a cyclic succinimide intermediate followed by isomerization to iso-aspartate.

Enhanced Potency

In accordance with another embodiment, Class 1 glucagon related analog peptides are provided that have enhanced potency at the glucagon receptor, wherein the peptides comprise an amino acid modification at position 16 of native glucagon (SEQ ID NO: 701). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. Substitution of serine at position 16 with glutamic acid enhances glucagon activity at least 2-fold, 4-fold, 5-fold and up to 10-fold greater at the glucagon receptor. In some embodiments, the Class 1 glucagon related analog peptide retains selectivity for the glucagon receptor relative to the GLP-1 receptors, e.g., at least 5-fold, 10-fold, or 15-fold selectivity.

DPP-IV Resistance

In some embodiments, the Class 1 glucagon peptides disclosed herein are further modified at position 1 or 2 to reduce susceptibility to cleavage by dipeptidyl peptidase IV. More particularly, in some embodiments, position 1 and/or position 2 of the Class 1 glucagon related analog peptide is substituted with the DPP-IV resistant amino acid(s) described herein. In one embodiment, position 2 of the analog peptide is substituted with an amino isobutyric acid. In one embodiment, position 2 of the analog peptide is substituted with an amino acid selected from the group consisting of D-serine, D-alanine, glycine, N-methyl serine, and ε-amino butyric acid. In another embodiment, position 2 of the Class 1 glucagon related analog peptide is substituted with an amino acid selected from the group consisting of D-serine, glycine, and aminoisobutyric acid.

Reduction in glucagon activity upon modification of the amino acids at position 1 and/or position 2 of the glucagon peptide can be restored by stabilization of the alpha-helix structure in the C-terminal portion of the glucagon peptide (around amino acids 12-29). The alpha helix structure can be stabilized by, e.g., formation of a covalent or non-covalent intramolecular bridge (e.g., a lactam bridge between side chains of amino acids at positions "i" and "i+4", wherein i is an integer from 12 to 25), substitution and/or insertion of amino acids around positions 12-29 with an alpha helix-stabilizing amino acid (e.g., an α,α-disubstituted amino acid), as further described herein.

Reducing Glucagon Activity by Modification at Position 3

Glucagon receptor activity can be reduced by an amino acid modification at position 3, e.g. substitution of the naturally occurring glutamine at position 3 with any amino acid. Substitution at this position with an acidic, basic, or a hydrophobic amino acid (glutamic acid, ornithine, norleucine) substantially reduces or destroys glucagon receptor activity.

Enhancing GLP-1 Activity with C-Terminal Amides and Esters

Enhanced activity at the GLP-1 receptor is provided by replacing the carboxylic acid of the C-terminal amino acid with a charge-neutral group, such as an amide or ester. Conversely, retaining the native carboxylic acid at the C-terminus of the peptide maintains the relatively greater selectivity of the Class 1 glucagon related analog peptide for the glucagon receptor vs. the GLP-1 receptor (e.g., greater than about 5, 6, 7, 8, 9, 10, 11, 12, 13, 14, 15, 16, 17, 18, 19, or 20-fold).

Further Modifications and Combinations

Additional modifications may be made to the Class 1 glucagon related analog peptide which may further increase solubility and/or stability and/or glucagon activity. The Class 1 glucagon related analog peptide may alternatively comprise other modifications that do not substantially affect solubility or stability, and that do not substantially decrease glucagon activity. In exemplary embodiments, the Class 1 glucagon related analog peptide may comprise a total of up to 11, or up to 12, or up to 13, or up to 14 amino acid modifications relative to the native glucagon sequence. For example, conservative or non-conservative substitutions, additions or deletions may be carried out at any of positions 2, 5, 7, 10, 11, 12, 13, 14, 17, 18, 19, 20, 21, 24, 27, 28 or 29.

Exemplary modifications of the Class 1 glucagon related analog peptide include but are not limited to:

(a) non-conservative substitutions, conservative substitutions, additions or deletions while retaining at least partial glucagon agonist activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;

(b) deletion of amino acids at positions 29 and/or 28, and optionally position 27, while retaining at least partial glucagon agonist activity;

(c) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;

(d) addition of a hydrophilic moiety such as the water soluble polymer polyethylene glycol, as described herein, e.g. at position 16, 17, 20, 21, 24, 29, 40 or at the C-terminal amino acid, which may increase solubility and/or half-life;

(e) modification of the methionine at position 27, for example, by substitution with leucine or norleucine, to reduce oxidative degradation;

(f) modification of the Gln at position 20 or 24, e.g. by substitution with Ala or AIB, to reduce degradation that occurs through deamidation of Gln (g) modification of Asp at position 21, e.g. by substitution with Glu, to reduce degradation that occurs through dehydration of Asp to form a cyclic succinimide intermediate followed by isomerization to iso-aspartate;

(h) modifications at position 1 or 2 as described herein that improve resistance to DPP-IV cleavage, optionally in combination with an intramolecular bridge such as a lactam bridge between positions "i" and "i+4", wherein i is an integer from 12 to 25, e.g., 12, 16, 20, 24;

(i) acylating the glucagon peptide as described herein, which may increase half-life in circulation and/or extending the duration of action and/or delaying the onset of action, optionally combined with addition of a hydrophilic moiety;

(j) C-terminal extensions as described herein;

(k) homodimerization or heterodimerization as described herein; and combinations of the (a) through (k).

In one embodiment, exemplary modifications of the Class 1 glucagon related analog peptide include at least one amino acid modification selected from Group A and one or more amino acid modifications selected from Group B and/or Group C, wherein Group A is:
substitution of Asn at position 28 with a charged amino acid;
substitution of Asn at position 28 with a charged amino acid selected from the group consisting of Lys, Arg, His, Asp, Glu, cysteic acid, and homocysteic acid;
substitution at position 28 with Asn, Asp, or Glu;
substitution at position 28 with Asp;
substitution at position 28 with Glu;

substitution of Thr at position 29 with a charged amino acid;
substitution of Thr at position 29 with a charged amino acid selected from the group consisting of Lys, Arg, His, Asp, Glu, cysteic acid, and homocysteic acid;
substitution at position 29 with Asp, Glu, or Lys;
substitution at position 29 with Glu;
insertion of 1-3 charged amino acids after position 29;
insertion after position 29 of Glu or Lys;
insertion after position 29 of Gly-Lys or Lys-Lys;
or combinations thereof;
wherein Group B is:
substitution of Asp at position 15 with Glu;
substitution of Ser at position 16 with Thr or AIB;
and wherein Group C is:
substitution of His at position 1 with a non-native amino acid that reduces susceptibility of the glucagon peptide to cleavage by dipeptidyl peptidase IV (DPP-IV),
substitution of Ser at position 2 with a non-native amino acid that reduces susceptibility of the glucagon peptide to cleavage by dipeptidyl peptidase IV (DPP-IV),
substitution of Lys at position 12 with Arg;
substitution of Gln at position 20 with Ala or AIB;
substitution of Asp at position 21 with Glu;
substitution of Gln at position 24 with Ala or AIB;
substitution of Met at position 27 with Leu or Nle;
deletion of amino acids at positions 27-29;
deletion of amino acids at positions 28-29;
deletion of the amino acid at positions 29;
or combinations thereof.

In exemplary embodiments, Lys at position 12 is substituted with Arg. In other exemplary embodiments amino acids at positions 29 and/or 28, and optionally at position 27, are deleted.

In some specific embodiments, the glucagon peptide comprises (a) an amino acid modification at position 1 and/or 2 that confers DPP-IV resistance, e.g., substitution with DMIA at position 1, or AIB at position 2, (b) an intramolecular bridge within positions 12-29, e.g. at positions 16 and 20, or one or more substitutions of the amino acids at positions 16, 20, 21, and 24 with an α,α disubstituted amino acid, optionally (c) linked to a hydrophilic moiety such as PEG, e.g., through Cys at position 24, 29 or at the C-terminal amino acid, optionally (d) an amino acid modification at position 27 that substitutes Met with, e.g., Nle, optionally (e) amino acid modifications at positions 20, 21 and 24 that reduce degradation, and optionally (f) linked to SEQ ID NO: 720. In other specific embodiments, the glucagon peptide comprises (a) Asp28Glu29, or Glu28Glu29, or Glu29Glu30, or Glu28Glu30 or Asp28Glu30, and optionally (b) an amino acid modification at position 16 that substitutes Ser with, e.g. Thr or AIB, and optionally (c) an amino acid modification at position 27 that substitutes Met with, e.g., Nle, and optionally (d) amino acid modifications at positions 20, 21 and 24 that reduce degradation. In a specific embodiment, the glucagon peptide is T16, A20, E21, A24, Nle27, D28, E29.

In one embodiment, the Class 1 glucagon related analog peptide comprises the amino acid sequence:
X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 739) with 1 to 3 amino acid modifications thereto,
wherein X1 and/or X2 is a non-native amino acid that reduces susceptibility of (or increases resistance of) the glucagon peptide to cleavage by dipeptidyl peptidase IV (DPP-IV),
wherein Z is selected from the group consisting of —COOH (the naturally occurring C-terminal carboxylate), -Asn-COOH, Asn-Thr-COOH, and Y—COOH, wherein Y is 1 to 2 amino acids, and
wherein an intramolecular bridge, preferably a covalent bond, connects the side chains of an amino acid at position i and an amino acid at position i+4, wherein i is 12, 16, 20 or 24.

In some embodiments, the intramolecular bridge is a lactam bridge. In some embodiments, the amino acids at positions i and i+4 of SEQ ID NO: 739 are Lys and Glu, e.g., Glu16 and Lys20. In some embodiments, X1 is selected from the group consisting of: D-His, N-methyl-His, alpha-methyl-His, imidazole acetic acid, des-amino-His, hydroxyl-His, acetyl-His, homo-His, and alpha, alpha-dimethyl imidiazole acetic acid (DMIA). In other embodiments, X2 is selected from the group consisting of: D-Ser, D-Ala, Gly, N-methyl-Ser, Val, and alpha, amino isobutyric acid (AIB). In some embodiments, the glucagon peptide is covalently linked to a hydrophilic moiety at any of amino acid positions 16, 17, 20, 21, 24, 29, 40, within a C-terminal extension, or at the C-terminal amino acid. In exemplary embodiments, this hydrophilic moiety is covalently linked to a Lys, Cys, Orn, homocysteine, or acetyl-phenylalanine residue at any of these positions. Exemplary hydrophilic moieties include polyethylene glycol (PEG), for example, of a molecular weight of about 1,000 Daltons to about 40,000 Daltons, or about 20,000 Daltons to about 40,000 Daltons.

In other embodiments, the Class I glucagon related analog peptide comprises the amino acid sequence:
X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 739),
wherein X1 and/or X2 is a non-native amino acid that reduces susceptibility of (or increases resistance of) the glucagon peptide to cleavage by dipeptidyl peptidase IV (DPP-IV), wherein one, two, three, four or more of positions 16, 20, 21, and 24 of the glucagon peptide is substituted with an α,α-disubstituted amino acid, and
wherein Z is selected from the group consisting of —COOH (the naturally occurring C-terminal carboxylate), -Asn-COOH, Asn-Thr-COOH, and Y—COOH, wherein Y is 1 to 2 amino acids.

Exemplary further amino acid modifications to the foregoing Class 1 glucagon related analog peptides or analogs include substitution of Lys at position 12 with Arg; substitution of Asp at position 15 with Glu; substitution of Ser at position 16 with Thr or AIB; substitution of Gln at position 20 with Ala or AIB; substitution of Asp at position 21 with Glu; substitution of Gln at position 24 with Ala or AIB; substitution of Met at position 27 with Leu or Nle; substitution of Asn at position 28 with a charged amino acid; substitution of Asn at position 28 with a charged amino acid selected from the group consisting of Lys, Arg, His, Asp, Glu, cysteic acid, and homocysteic acid; substitution at position 28 with Asn, Asp, or Glu; substitution at position 28 with Asp; substitution at position 28 with Glu; substitution of Thr at position 29 with a charged amino acid; substitution of Thr at position 29 with a charged amino acid selected from the group consisting of Lys, Arg, His, Asp, Glu, cysteic acid, and homocysteic acid; substitution at position 29 with Asp, Glu, or Lys; substitution at position 29 with Glu; insertion of 1-3 charged amino acids after position 29; insertion at position 30 (i.e., after position 29) of Glu or Lys; optionally with insertion at position 31 of Lys; addition of SEQ ID NO: 720 to the C-terminus; or a combination thereof.

Any of the modifications described above in reference to Class 1 glucagon agonists which increase glucagon receptor activity, retain partial glucagon receptor activity, improve solubility, increase stability, or reduce degradation can be applied to Class 1 glucagon peptides individually or in combination. Thus, Class 1 glucagon related analog peptides can be prepared that retain at least 20% of the activity of native glucagon at the glucagon receptor, and which are soluble at a concentration of at least 1 mg/mL at a pH between 6 and 8 or between 6 and 9, (e.g. pH 7), and optionally retain at least 95% of the original peptide (e.g. 5% or less of the original peptide is degraded or cleaved) after 24 hours at 25° C. Alternatively, high potency Class 1 glucagon peptides can be prepared that exhibit at least about 100%, 125%, 150%, 175%, 200%, 250%, 300%, 350%, 400%, 450%, 500%, 600%, 700%, 800%, 900% or 10-fold or more of the activity of native glucagon at the glucagon receptor, and optionally are soluble at a concentration of at least 1 mg/mL at a pH between 6 and 8 or between 6 and 9, (e.g. pH 7), and optionally retains at least 95% of the original peptide (e.g. 5% or less of the original peptide is degraded or cleaved) after 24 hours at 25° C.

Examples of Embodiments of Class 1 Glucagon Related Analog Peptides

In accordance with one embodiment, the native glucagon peptide of SEQ ID NO: 701 is modified by the substitution of the native amino acid at position 28 and/or 29 with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the native glucagon peptide of SEQ ID NO: 701 is modified by the substitution of the native amino acid at position 29 with a positively charged amino acid (e.g., lysine, arginine or histidine) and optionally the addition of one or two positively charged amino acid (e.g., lysine, arginine or histidine) on the carboxy terminus of the peptide. In accordance with one embodiment, a Class 1 glucagon related analog peptide having improved solubility and stability is provided wherein the peptide comprises the amino acid sequence of SEQ ID NO: 734 with the proviso that at least one amino acids at position, 28, or 29 is substituted with an acidic amino acid and/or an additional acidic amino acid is added at the carboxy terminus of SEQ ID NO: 734. In one embodiment the acidic amino acids are independently selected from the group consisting of Asp, Glu, cysteic acid and homocysteic acid.

In accordance with one embodiment, a Class 1 glucagon related analog peptide having improved solubility and stability is provided wherein the agonist comprises the amino acid sequence of SEQ ID NO: 733, wherein at least one of the amino acids at positions 27, 28 or 29 is substituted with a non-native amino acid residue (i.e. at least one amino acid present at position 27, 28 or 29 of the analog is an acid amino acid different from the amino acid present at the corresponding position in SEQ ID NO: 701). In accordance with one embodiment, a Class 1 glucagon related analog peptide is provided comprising the sequence of SEQ ID NO: 733 with the proviso that when the amino acid at position 28 is asparagine and the amino acid at position 29 is threonine, the peptide further comprises one to two amino acids, independently selected from the group consisting of Lys, Arg, His, Asp or Glu, added to the carboxy terminus of the glucagon peptide.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 16, 17, 18, 19, 20, 21, 24, 27, 28 or 29 of the peptide of SEQ ID NO: 711 can be substituted with an amino acid different from that present in the native glucagon peptide, and still retain the enhanced potency, physiological pH stability and biological activity of the parent glucagon peptide. For example, in accordance with one embodiment the methionine residue present at position 27 of the native peptide is changed to leucine or norleucine to prevent oxidative degradation of the peptide.

In one embodiment a Class 1 glucagon related analog peptide of SEQ ID NO: 733 is provided wherein 1 to 6 amino acids, selected from positions 1, 2, 5, 7, 10, 11, 12, 13, 14, 16, 17, 18, 19, 20, 21 or 24 of the analog differ from the corresponding amino acid of SEQ ID NO: 701. In accordance with another embodiment a Class 1 glucagon related analog peptide of SEQ ID NO: 733 is provided wherein 1 to 3 amino acids selected from positions 1, 2, 5, 7, 10, 11, 12, 13, 14, 16, 17, 18, 19, 20, 21 or 24 of the peptide differ from the corresponding amino acid of SEQ ID NO: 701. In another embodiment, a Class 1 glucagon related analog peptide of SEQ ID NO: 707, SEQ ID NO: 708 or SEQ ID NO: 734 is provided wherein 1 to 2 amino acids selected from positions 1, 2, 5, 7, 10, 11, 12, 13, 14, 16, 17, 18, 19, 20, 21 or 24 of the peptide differ from the corresponding amino acid of SEQ ID NO: 701, and in a further embodiment those one to two differing amino acids represent conservative amino acid substitutions relative to the amino acid present in the native sequence (SEQ ID NO: 701). In one embodiment a Class 1 glucagon related analog peptide of SEQ ID NO: 711 or SEQ ID NO: 713 is provided wherein the glucagon peptide further comprises one, two or three amino acid substitutions at positions selected from positions 2, 5, 7, 10, 11, 12, 13, 14, 16, 17, 18, 19, 20, 21, 24, 27 or 29. In one embodiment the substitutions at positions 2, 5, 7, 10, 11, 12, 13, 14, 16, 17, 18, 19, 20, 27 or 29 are conservative amino acid substitutions.

In one embodiment a Class 1 glucagon related analog peptide is provided comprising an analog peptide of SEQ ID NO: 701 wherein the peptide differs from SEQ ID NO: 701 by having an amino acid other than serine at position 2 and by having an acidic amino acid substituted for the native amino acid at position 28 or 29 or an acidic amino acid added to the carboxy terminus of the peptide of SEQ ID NO: 701. In one embodiment the acidic amino acid is aspartic acid or glutamic acid. In one embodiment a Class 1 glucagon related analog peptide of SEQ ID NO: 709, SEQ ID NO: 712, SEQ ID NO: 713 or SEQ ID NO: 732 is provided wherein the peptide differs from the parent molecule by a substitution at position 2. More particularly, position 2 of the peptide is substituted with an amino acid selected from the group consisting of D-serine, alanine, D-alanine, glycine, n-methyl serine and amino isobutyric acid.

In another embodiment a Class 1 glucagon related analog peptide is provided comprising a peptide of SEQ ID NO: 701 wherein the peptide differs from SEQ ID NO: 701 by having an amino acid other than histidine at position 1 and by having an acidic amino acid substituted for the native amino acid at position 28 or 29 or an acidic amino acid added to the carboxy terminus of the peptide of SEQ ID NO: 701. In one embodiment the acidic amino acid is aspartic acid or glutamic acid. In one embodiment a Class 1 glucagon related analog peptide of SEQ ID NO: 709, SEQ ID NO: 712, SEQ ID NO: 713 or SEQ ID NO: 732 is provided wherein the peptide differs from the parent molecule by a substitution at position 1. More particularly, position 1 of the peptide is substituted with an amino acid selected from the group consisting of DMIA, D-histidine, desaminohistidine, hydroxyl-histidine, acetyl-histidine and homo-histidine.

In accordance with one embodiment the Class 1 glucagon related analog peptide comprises a sequence selected from the group consisting of SEQ ID NO: 709, SEQ ID NO: 712, SEQ ID NO: 713 and SEQ ID NO: 732. In a further embodiment a Class 1 glucagon related analog peptide is provided comprising a sequence of SEQ ID NO: 709, SEQ ID NO: 712, SEQ ID NO: 713 or SEQ ID NO: 732 further comprising one to two amino acids, added to the C-terminus of SEQ ID NO: 709, SEQ ID NO: 712, SEQ ID NO: 713 or SEQ ID NO: 732, wherein the additional amino acids are independently selected from the group consisting of Lys, Arg, His, Asp Glu, cysteic acid or homocysteic acid. In one embodiment the additional amino acids added to the carboxy terminus are selected from the group consisting of Lys, Arg, His, Asp or Glu or in a further embodiment the additional amino acids are Asp or Glu.

In another embodiment the Class 1 glucagon related analog peptide comprises the sequence of SEQ ID NO: 707 or a glucagon agonist analog thereof. In one embodiment the peptide comprising a sequence selected from the group consisting of SEQ ID NO: 708, SEQ ID NO: 710, SEQ ID NO: 711, SEQ ID NO: 712 and SEQ ID NO: 713. In another embodiment the peptide comprising a sequence selected from the group consisting of SEQ ID NO: 708, SEQ ID NO: 710 and SEQ ID NO: 711. In one embodiment the Class 1 glucagon related analog peptide comprises the sequence of SEQ ID NO: 708, SEQ ID NO: 710 and SEQ ID NO: 711 further comprising an additional amino acid, selected from the group consisting of Asp and Glu, added to the C-terminus of the glucagon peptide. In one embodiment the Class 1 glucagon related analog peptide comprises the sequence of SEQ ID NO: 711 or SEQ ID NO: 713, and in a further embodiment the glucagon peptide comprises the sequence of SEQ ID NO: 711.

In accordance with one embodiment a Class 1 glucagon related analog peptide is provided comprising a modified glucagon peptide selected from the group consisting of:

NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 734),

NH$_2$-His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asp-Thr-R (SEQ ID NO: 711) and NH$_2$-His-Ser-Gln-Gly-Thr-Phe-Thr-Ser-Asp-Tyr-Ser-Xaa-Tyr-Leu-Glu-Ser-Arg-Arg-Ala-Gln-Asp-Phe-Val-Gln-Trp-Leu-Met-Asp-Thr-R (SEQ ID NO: 713)

wherein Xaa at position 15 is Asp, Glu, cysteic acid, homoglutamic acid or homocysteic acid, the Xaa at position 28 is Asn or an acidic amino acid and the Xaa at position 29 is Thr or an acidic amino acid and R is an acidic amino acid, COOH or CONH$_2$, with the proviso that an acidic acid residue is present at one of positions 28, 29 or 30. In one embodiment R is COOH, and in another embodiment R is CONH$_2$.

More particularly, the Class 1 glucagon related analog peptide may be a fusion glucagon peptide comprising a glucagon agonist analog comprising a glucagon peptide NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 734), wherein R is an acidic amino acid or a bond and an amino acid sequence of SEQ ID NO: 720 (GPSSGAPPPS), SEQ ID NO: 721 (KRNRNNIA) or SEQ ID NO: 722 (KRNR) linked to the carboxy terminal amino acid of the glucagon peptide sequence. In one embodiment the glucagon peptide is selected from the group consisting of SEQ ID NO: 733, SEQ ID NO: 707 or SEQ ID NO: 708 further comprising an amino acid sequence of SEQ ID NO: 720 (GPSSGAPPPS), SEQ ID NO: 721 (KRNRNNIA) or SEQ ID NO: 722 (KRNR) linked to the carboxy terminal amino acid of the glucagon peptide sequence. In one embodiment the glucagon fusion peptide comprises SEQ ID NO: 702, SEQ ID NO: 703, SEQ ID NO: 704, SEQ ID NO: 705 and SEQ ID NO: 706 or a glucagon agonist analog thereof, further comprising an amino acid sequence of SEQ ID NO: 720 (GPSSGAPPPS), SEQ ID NO: 721 (KRNRNNIA) or SEQ ID NO: 722 (KRNR) linked to amino acid 29 of the glucagon fusion peptide sequence. In accordance with one embodiment the fusion peptide further comprises a PEG chain linked to an amino acid at position 16, 17, 21, 24, 29, within a C-terminal extension, or at the C-terminal amino acid, wherein the PEG chain is selected from the range of 500 to 40,000 Daltons. In one embodiment the amino acid sequence of SEQ ID NO: 720 (GPSSGAPPPS), SEQ ID NO: 721 (KRNRNNIA) or SEQ ID NO: 722 (KRNR) is bound to amino acid 29 of the glucagon peptide through a peptide bond. In one embodiment the glucagon peptide portion of the glucagon fusion peptide comprises a sequence selected from the group consisting of SEQ ID NO: 710, SEQ ID NO: 711 and SEQ ID NO: 713. In one embodiment the glucagon peptide portion of the glucagon fusion peptide comprises the sequence of SEQ ID NO: 711 or SEQ ID NO: 713, wherein a PEG chain is linked at position 21, 24, 29, within a C-terminal extension or at the C-terminal amino acid, respectively.

In another embodiment the glucagon peptide sequence of the fusion peptide comprises the sequence of SEQ ID NO: 711, further comprising an amino acid sequence of SEQ ID NO: 720 (GPSSGAPPPS), SEQ ID NO: 721 (KRNRNNIA) or SEQ ID NO: 722 (KRNR) linked to amino acid 29 of the glucagon peptide. In one embodiment the glucagon fusion peptide comprises a sequence selected from the group consisting of SEQ ID NO: 724, SEQ ID NO: 725 and SEQ ID NO: 726. Typically the fusion peptides of the present invention will have a C-terminal amino acid with the standard carboxylic acid group. However, analogs of those sequences wherein the C-terminal amino acid has an amide substituted for the carboxylic acid are also encompassed as embodiments. In accordance with one embodiment the fusion glucagon peptide comprises a glucagon agonist analog selected from the group consisting of SEQ ID NO: 710, SEQ ID NO: 711 and SEQ ID NO: 713, further comprising an amino acid sequence of SEQ ID NO: 723 (GPSSGAPPPS-CONH$_2$) linked to amino acid 29 of the glucagon peptide.

Exemplary glucagon peptides are selected from the group consisting of SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711 and SEQ ID NO: 733, wherein amino acid 29 of the glucagon peptide is bound to a second peptide through a peptide bond, and said second peptide comprises the sequence of SEQ ID NO: 720, SEQ ID NO: 721 or SEQ ID NO: 722. In one embodiment the glucagon peptide is pegylated.

The Class 1 glucagon related analog peptides described herein can be further modified to improve the peptide's solubility and stability in aqueous solutions while retaining the biological activity of the glucagon peptide. In accordance with one embodiment, introduction of hydrophilic groups at one or more positions selected from positions 16, 17, 20, 21, 24 and 29 of the peptide of SEQ ID NO: 711, or a glucagon agonist analog thereof, are anticipated to improve the solubility and stability. More particularly, in one embodiment the Class 1 glucagon related analog peptide of SEQ ID NO: 710, SEQ ID NO: 711, SEQ ID NO: 713, or SEQ ID NO: 732 is modified to comprise one or more hydrophilic groups covalently linked to the side chains of amino acids present at positions 21 and 24 of the glucagon peptide.

In accordance with one embodiment, the Class 1 glucagon related analog peptide of SEQ ID NO: 711 is modified to contain one or more amino acid substitution at positions 16, 17, 20, 21, 24 and/or 29, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein.

In one embodiment, a Class 1 glucagon related analog peptide of SEQ ID NO: 710, SEQ ID NO: 711 or SEQ ID NO: 713 is provided wherein the native glucagon peptide sequence has been modified to contain a naturally occurring or synthetic amino acid in at least one of positions 16, 17, 21, 24, 29, within a C-terminal extension or at the C-terminal amino acid of the native sequence, wherein the amino acid substitute further comprises a hydrophilic moiety. In one embodiment the substitution is at position 21 or 24, and in a further embodiment the hydrophilic moiety is a PEG chain. In one embodiment the Class 1 glucagon related analog peptide of SEQ ID NO: 711 is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, the native glucagon peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In one embodiment the Class 1 glucagon related analog peptide is selected form the group consisting of SEQ ID NO: 714, SEQ ID NO: 715, SEQ ID NO: 716, SEQ ID NO: 717, SEQ ID NO: 718 and SEQ ID NO: 719.

In accordance with one embodiment the pegylated Class 1 glucagon related analog peptide comprises two or more polyethylene chains covalently bound to the glucagon peptide wherein the total molecular weight of the glucagon chains is about 1,000 to about 5,000 Daltons. In one embodiment the pegylated Class 1 glucagon related analog peptide comprises a peptide of SEQ ID NO: 706, wherein a PEG chain is covalently linked to the amino acid residue at position 21 and at position 24, and wherein the combined molecular weight of the two PEG chains is about 1,000 to about 5,000 Daltons. In another embodiment the pegylated Class 1 glucagon related analog peptide comprises a peptide of SEQ ID NO: 706, wherein a PEG chain is covalently linked to the amino acid residue at position 21 and at position 24, and wherein the combined molecular weight of the two PEG chains is about 5,000 to about 20,000 Daltons.

The polyethylene glycol chain may be in the form of a straight chain or it may be branched. In accordance with one embodiment the polyethylene glycol chain has an average molecular weight selected from the range of about 500 to about 40,000 Daltons. In one embodiment the polyethylene glycol chain has a molecular weight selected from the range of about 500 to about 5,000 Daltons. In another embodiment the polyethylene glycol chain has a molecular weight of about 20,000 to about 40,000 Daltons.

The glucagon agonist may be a peptide comprising the amino acid sequence of any of the amino acid sequences of SEQ ID NOs: 701-758, optionally with up to 1, 2, 3, 4, or 5 further modifications that retain glucagon agonist activity.

Class 2 Glucagon Related Analog Peptides

In certain embodiments, the glucagon related analog peptide is a Class 2 glucagon related analog peptide, which is described herein and in U.S. Provisional Application No. 61/090,448, the contents of which are incorporated by reference in their entirety.

Activity

Native glucagon does not activate the GIP receptor, and normally has about 1% of the activity of native-GLP-1 at the GLP-1 receptor. Modifications to the native glucagon sequence described herein produce Class 2 glucagon related analog peptides that can exhibit potent glucagon activity equivalent to or better than the activity of native glucagon (SEQ ID NO: 801), potent GIP activity equivalent to or better than the activity of native GIP (SEQ ID NO: 804), and/or potent GLP-1 activity equivalent to or better than the activity of native GLP-1. In this regard, the Class 2 glucagon related analog peptide may be one of a glucagon/GIP co-agonist, glucagon/GIP/GLP-1 tri-agonist, GIP/GLP-1 co-agonist, or a GIP agonist glucagon peptide, as further described herein.

In some embodiments, the Class 2 glucagon related analog peptides described herein exhibit an EC50 for GIP receptor activation activity of about 100 nM or less, or about 75, 50, 25, 10, 8, 6, 5, 4, 3, 2 or 1 nM or less. In some embodiments, the Class 2 glucagon related analog peptides exhibit an EC50 for glucagon receptor activation of about 100 nM or less, or about 75, 50, 25, 10, 8, 6, 5, 4, 3, 2 or 1 nM or less. In some embodiments, the Class 2 glucagon related analog peptides exhibit an EC50 for GLP-1 receptor activation of about 100 nM or less, or about 75, 50, 25, 10, 8, 6, 5, 4, 3, 2 or 1 nM or less. Receptor activation can be measured by in vitro assays measuring cAMP induction in HEK293 cells over-expressing the receptor, e.g. assaying HEK293 cells co-transfected with DNA encoding the receptor and a luciferase gene linked to cAMP responsive element as described in Example 2.

In some embodiments, Class 2 glucagon related analog peptides exhibit at least about 0.1%, 0.2%, 0.3%, 0.4%, 0.5%, 0.6%, 0.7%, 0.8%, 0.9%, 1%, 5%, 10%, 20%, 30%, 40%, 50%, 60%, 75%, 100%, 125%, 150%, 175% or 200% or higher activity at the GIP receptor relative to native GIP (GIP potency). In some embodiments, Class 2 glucagon related analog peptides exhibit at least about 1%, 5%, 10%, 20%, 30%, 40%, 50%, 60%, 75%, 100%, 125%, 150%, 175%, 200%, 250%, 300%, 350%, 400%, 450%, or 500% or higher activity at the glucagon receptor relative to native glucagon (glucagon potency). In some embodiments, Class 2 glucagon related analog peptides exhibit at least about 0.1%, 0.2%, 0.3%, 0.4%, 0.5%, 0.6%, 0.7%, 0.8%, 0.9%, 1%, 5%, 10%, 20%, 30%, 40%, 50%, 60%, 75%, 100%, 125%, 150%, 175% or 200% or higher activity at the GLP-1 receptor relative to native GLP-1 (GLP-1 potency). A Class 2 glucagon related analog peptide's activity at a receptor relative to a native ligand of the receptor is calculated as the inverse ratio of EC50s for the Class 2 glucagon related analog peptide vs. the native ligand.

In one embodiment, Class 2 glucagon related analog peptides exhibit activity at both the glucagon receptor and the GIP receptor ("glucagon/GIP co-agonists"). These Class 2 glucagon related analog peptides have lost native glucagon's selectivity for glucagon receptor compared to GIP receptor. In some embodiments, the EC50 of the Class 2 glucagon related analog peptide at the GIP receptor is less than about 50-fold, 40-fold, 30-fold or 20-fold different (higher or lower) from its EC50 at the glucagon receptor. In some embodiments, the GIP potency of the Class 2 glucagon related analog peptide is less than about 500-, 450-, 400-, 350-, 300-, 250-, 200-, 150-, 100-, 75-, 50-, 25-, 20-, 15-, 10-, or 5-fold different (higher or lower) from its glucagon potency. In some embodiments, the ratio of the EC50 of the Class 2 glucagon related analog peptide at the GIP receptor divided by the EC50 of the Class 2 glucagon related analog peptide at the glucagon receptor is less than about 100, 75, 60, 50, 40, 30, 20, 15, 10, or 5. In some embodiments, the ratio of the GIP potency of the Class 2 glucagon related analog peptide compared to the glucagon potency of the Class 2 glucagon related analog peptide is less than about 500, 450, 400, 350, 300, 250, 200, 150, 100, 75, 60, 50, 40, 30, 20, 15, 10, or 5. In some embodiments, GLP-1 activity have been significantly reduced or destroyed, e.g., by an amino acid modification at position 7.

In another aspect, Class 2 glucagon related analog peptides exhibit activity at the glucagon, GIP and GLP-1 receptors ("glucagon/GIP/GLP-1 tri-agonists"). These Class 2 glucagon related analog peptides have lost native glucagon's selectivity for the glucagon receptor compared to both the GLP-1 and GIP receptors. In some embodiments, the EC50 of the Class 2 glucagon related analog peptide at the GIP receptor is less than about 50-fold, 40-fold, 30-fold or 20-fold different (higher or lower) from its respective EC50s at the glucagon and GLP-1 receptors. In some embodiments, the GIP potency of the Class 2 glucagon related analog peptide is less than about 500-, 450-, 400-, 350-, 300-, 250-, 200-, 150-, 100-, 75-, 50-, 25-, 20-, 15-, 10-, or 5-fold different (higher or lower) from its glucagon and GLP-1 potencies. In some embodiments, the ratio of the EC50 of the tri-agonist at the GIP receptor divided by the EC50 of the tri-agonist at the GLP-1 receptor is less than about 100, 75, 60, 50, 40, 30, 20, 15, 10, or 5. In some embodiments, the ratio of the GIP potency of the tri-agonist compared to the GLP-1 potency of the tri-agonist is less than about 100, 75, 60, 50, 40, 30, 20, 15, 10, or 5. In related embodiments, the ratio of the EC50 of the tri-agonist at the GIP receptor divided by the EC50 of the tri-agonist at the glucagon receptor is less than about 100, 75, 60, 50, 40, 30, 20, 15, 10, or 5. In some embodiments, the ratio of the GIP potency of the tri-agonist compared to the glucagon potency of the tri-agonist is less than about 500, 450, 400, 350, 300, 250, 200, 150, 100, 75, 60, 50, 40, 30, 20, 15, 10, or 5.

In yet another aspect, Class 2 glucagon related analog peptides exhibit activity at the GLP-1 and GIP receptors, but in which the glucagon activity has been significantly reduced or destroyed ("GIP/GLP-1 co-agonists"), e.g., by an amino acid modification at position 3. For example, substitution at this position with an acidic, basic, or a hydrophobic amino acid (glutamic acid, ornithine, norleucine) reduces glucagon activity. In some embodiments, the EC50 of the glucagon peptide at the GIP receptor is less than about 50-fold, 40-fold, 30-fold or 20-fold different (higher or lower) from its EC50 at the GLP-1 receptor. In some embodiments, the GIP potency of the Class 2 glucagon related analog peptide is less than about 25-, 20-, 15-, 10-, or 5-fold different (higher or lower) from its GLP-1 potency. In some embodiments these Class 2 glucagon related analog peptides have about 10% or less of the activity of native glucagon at the glucagon receptor, e.g. about 1-10%, or about 0.1-10%, or greater than about 0.1% but less than about 10%. In some embodiments, the ratio of the EC50 of the Class 2 glucagon related analog peptide at the GIP receptor divided by the EC50 of the Class 2 glucagon related analog peptide at the GLP-1 receptor is less than about 100, 75, 60, 50, 40, 30, 20, 15, 10, or 5. In some embodiments, the ratio of the GIP potency of the Class 2 glucagon related analog peptide compared to the GLP-1 potency of the Class 2 glucagon related analog peptide is less than about 100, 75, 60, 50, 40, 30, 20, 15, 10, or 5.

In a further aspect, Class 2 glucagon related analog peptides exhibit activity at the GIP receptor, in which the glucagon and GLP-1 activity have been significantly reduced or destroyed ("GIP agonist glucagon peptides"), e.g., by amino acid modifications at positions 3 and 7. In some embodiments, these Class 2 glucagon related analog peptides have about 10% or less of the activity of native glucagon at the glucagon receptor, e.g. about 1-10%, or about 0.1-10%, or greater than about 0.1%, 0.5%, or 1% but less than about 1%, 5%, or 10%. In some embodiments these Class 2 glucagon related analog peptides also have about 10% or less of the activity of native GLP-1 at the GLP-1 receptor, e.g. about 1-10%, or about 0.1-10%, or greater than about 0.1%, 0.5%, or 1% but less than about 1%, 5%, or 10%.

In some embodiments, when the Class 2 glucagon related analog peptide is not pegylated, the EC50 of the Class 2 glucagon related analog peptide for GIP receptor activation is about 4, 2, 1 nM or less, or the analog has at least about 1%, 2%, 3%, 4% or 5% of the activity of native GIP at the GIP receptor. In related embodiments, the EC50 of the unpegylated Class 2 glucagon related analog peptide for GLP-1 receptor activation is about 4, 2, 1 nM or less or has at least about 1%, 2%, 3%, 4% or 5% of the activity of native GLP-1 at the GLP-1 receptor. In yet other related embodiments, the EC50 of the unpegylated Class 2 glucagon related analog peptide for glucagon receptor activation is about 4, 2, 1 nM or less, or at least about 5%, 10%, 15% or 20% of the activity of native glucagon at the glucagon receptor. In some embodiments, the unpegylated Class 2 glucagon related analog peptide has less than about 1% of the activity of native glucagon at the glucagon receptor. In other embodiments, the unpegylated Class 2 glucagon related analog peptide has less than about 10%, 5% or 1% of the activity of native GLP-1 at the GLP-1 receptor.

In embodiments where the Class 2 glucagon related analog peptides are linked to hydrophilic moieties such as PEG, the relative EC50s at one or more receptors may be higher. For example, the EC50 of a pegylated analog for GIP receptor activation is about 10 nM or less, or the Class 2 glucagon related analog peptide has at least about 0.1%, 0.2%, 0.3%, 0.4% or 0.5% of the activity of native GIP at the GIP receptor. In related embodiments, the EC50 of a pegylated Class 2 glucagon related analog peptide for GLP-1 receptor activation is about 10 nM or less or has at least about 0.1%, 0.2%, 0.3%, 0.4% or 0.5% of the activity of native GLP-1 at the GLP-1 receptor. In yet other related embodiments, the EC50 of a pegylated Class 2 glucagon related analog peptide for glucagon receptor activation is about 10 nM or less, or at least about 0.5%, 1%, 1.5% or 2% of the activity of native glucagon at the glucagon receptor. In some embodiments, the Class 2 glucagon related analog peptide has less than about 1% of the activity of native glucagon at the glucagon receptor. In other embodiments, the Class 2 glucagon related analog peptide has less than about 10%, 5% or 1% of the activity of native GLP-1 at the GLP-1 receptor.

Modifications

The modifications disclosed herein in reference to a Class 2 glucagon related analog peptide permit the manipulation of glucagon (SEQ ID NO: 801) to create glucagon peptides that exhibit increased GIP activity, glucagon activity, and/or GLP-1 activity. Other modifications disclosed herein in reference to a Class 2 glucagon related analog peptide prolong the half-life, increase solubility, or increase stability of the resulting peptide. Yet other modifications disclosed herein in reference to a Class 2 glucagon related analog peptide have no effect on activity, or can be made without destroying the desired activity or activities. Any of the combinations in reference to a Class 2 glucagon related analog peptide that serve the same purpose (e.g. increasing GIP activity) can be applied individually or in combination. Any of the single or sets of combinations in reference to a Class 2 glucagon related analog peptide that confer enhanced properties can be applied individually or in combination, e.g. increased GIP and/or GLP-1 activity can be combined with increased half-life. In related embodiments, 1, 2, 3, 4, 5, 6 or more of the amino acid modifications may be non-conservative substitutions, additions or deletions. In some embodiments, 1, 2, 3, 4, 5, 6 or more of the amino acid modifications may be conservative substitutions.

Modifications that Affect GIP Activity

Enhanced activity at the GIP receptor is provided by an amino acid modification at position 1. For example, His at position 1 is substituted with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr. The combination of Tyr at position 1 with stabilization of the alpha helix within the region corresponding to amino acids 12-29 provided a Class 2 glucagon related analog peptide that activates the GIP receptor as well as the GLP-1 receptor and the glucagon receptor. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid).

Enhanced activity at the GIP receptor is also provided by amino acid modifications at positions 27 and/or 28, and optionally at position 29. For example, the Met at position 27 is substituted with a large aliphatic amino acid, optionally Leu, the Asn at position 28 is substituted with a small aliphatic amino acid, optionally Ala, and the Thr at position 29 is substituted with a small aliphatic amino acid, optionally Gly. Substitution with LAG at positions 27-29 provides increased GIP activity relative to the native MNT sequence at those positions.

Enhanced activity at the GIP receptor is also provided by an amino acid modification at position 12. For example, position 12 is substituted with a large, aliphatic, nonpolar amino acid, optionally Ile.

Enhanced activity at the GIP receptor is also provided by an amino acid modification at positions 17 and/or 18. For example, position 17 is substituted with a polar residue, optionally Gln, and position 18 is substituted with a small aliphatic amino acid, optionally Ala. A substitution with QA at positions 17 and 18 provides increased GIP activity relative to the native RR sequence at those positions.

Increased activity at the GIP receptor is provided by modifications that permit formation of an intramolecular bridge between amino acid side chains at positions from 12 to 29. For example, an intramolecular bridge can be formed by a covalent bond between the side chains of two amino acids at positions i and i+4 or between positions j and j+3, or between positions k and k+7. In exemplary embodiments, the bridge is between positions 12 and 16, 16 and 20, 20 and 24, 24 and 28, or 17 and 20. In other embodiments, non-covalent interactions such as salt bridges can be formed between positively and negatively charged amino acids at these positions.

Any of the modifications described above which increase GIP receptor activity can be applied individually or in combination. Combinations of the modifications that increase GIP receptor activity generally provide higher GIP activity than any of such modifications taken alone.

Modifications that Affect Glucagon Activity

In one embodiment, enhanced glucagon potency is provided by an amino acid modification at position 16 of native glucagon (SEQ ID NO: 801). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In some embodiments the glucagon peptide retains its original selectivity for the glucagon receptor relative to the GLP-1 receptors.

Glucagon receptor activity can be reduced by an amino acid modification at position 3, e.g. substitution of the naturally occurring glutamine at position 3 with any amino acid. Substitution at this position with an acidic, basic, or a hydrophobic amino acid (glutamic acid, ornithine, norleucine) has been shown to substantially reduce or destroy glucagon receptor activity. In such cases, pegylation of such a peptide comprising a substitution at position 3 increased the glucagon receptor activity.

Restoration of glucagon activity which has been reduced by amino acid modifications at positions 1 and 2 is provided by modifications that permit formation of an intramolecular bridge between amino acid side chains at positions from 12 to 29. For example, an intramolecular bridge can be formed by a covalent bond between the side chains of two amino acids at positions i and i+4 or between positions j and j+3, or between positions k and k+7. In other embodiments, non-covalent interactions such as salt bridges can be formed between positively and negatively charged amino acids at these positions.

Modifications that Affect GLP-1 Activity

Enhanced activity at the GLP-1 receptor is provided by replacing the carboxylic acid of the C-terminal amino acid with a charge-neutral group, such as an amide or ester.

Enhanced activity at the GLP-1 receptor is also provided by stabilizing the alpha-helix structure in the C-terminal portion of glucagon (around amino acids 12-29), e.g., through formation of an intramolecular bridge between the side chains of two amino acids, or substitution and/or insertion of amino acids around positions 12-29 with an alpha helix-stabilizing amino acid (e.g., an α,α-disubstituted amino acid), as further described herein. In exemplary embodiments, the side chains of the amino acid pairs 12 and 16, 13 and 17, 16 and 20, 17 and 21, 20 and 24 or 24 and 28 (amino acid pairs in which i=12, 16, 20, or 24) are linked to one another and thus stabilize the glucagon alpha helix. In some embodiments, the bridge or linker is about 8 (or about 7-9) atoms in length, particularly when the bridge is between positions i and i+4. In some embodiments, the bridge or linker is about 6 (or about 5-7) atoms in length, particularly when the bridge is between positions j and j+3.

In some embodiments, intramolecular bridges are formed by (a) substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms, and (b) substituting the naturally occurring glutamine at position 20 with another hydrophilic amino acid having a side chain that is either charged or has an ability to hydrogen-bond, and is at least about 5 (or about 4-6) atoms in length, for example, lysine, citrulline, arginine, or ornithine. The side chains of such amino acids at positions 16 and 20 can form a salt bridge or can be covalently linked. In one embodiment the two amino acids are bound to one another to form a lactam ring.

In some embodiments, stabilization of the alpha helix structure in the C-terminal portion of the glucagon peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization are used to stabilize the alpha helix.

In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., AIB.

Increased activity at the GLP-1 receptor is provided by an amino acid modification at position 20 as described herein.

Increased activity at the GLP-1 receptor is provided by adding GPSSGAPPPS (SEQ ID NO: 895) or XGPSSGAPPPS (SEQ ID NO: 896) to the C-terminus. GLP-1 activity in such analogs can be further increased by modifying the amino acid at position 18, 28 or 29, or at position 18 and 29, as described herein.

A further modest increase in GLP-1 potency is provided by modifying the amino acid at position 10 to be a large, aromatic amino acid residue, optionally Trp.

Reduced activity at the GLP-1 receptor is provided, e.g., by an amino acid modification at position 7 as described herein.

Potency at the GLP-1 receptor can be further enhanced by an alanine substitution for the native arginine at position 18.

Any of the modifications described above in reference to a Class 2 glucagon related analog peptide which increase GLP-1 receptor activity can be applied individually or in combination. Combinations of the modifications that increase GLP-1 receptor activity generally provide higher GLP-1 activity than any of such modifications taken alone. For example, the invention provides glucagon peptides that comprise modifications at position 16, at position 20, and at the C-terminal carboxylic acid group, optionally with a covalent bond between the amino acids at positions 16 and 20; glucagon peptides that comprise modifications at position 16 and at the C-terminal carboxylic acid group; glucagon peptides that comprise modifications at positions 16 and 20, optionally with a covalent bond between the amino acids at positions 16 and 20; and glucagon peptides that comprise modifications at position 20 and at the C-terminal carboxylic acid group.

Modifications that Improve DPP-IV Resistance

Modifications at position 1 and/or 2 can increase the peptide's resistance to dipeptidyl peptidase IV (DPP IV) cleavage. For example, position 1 and/or position 2 may be substituted with a DPP-IV resistant amino acid as described herein. In one embodiment, the amino acid at position 2 is substituted with N-methyl alanine.

It was observed that modifications at position 2 (e.g. AIB at position 2) and in some cases modifications at position 1 (e.g., DMIA at position 1) may reduce glucagon activity, sometimes significantly; surprisingly, this reduction in glucagon activity can be restored by stabilizing the alpha-helix structure in the C-terminal portion of glucagon (around amino acids 12-29), e.g., through formation of a covalent bond between the side chains of two amino acids, as described herein. In some embodiments, the covalent bond is between amino acids at positions "i" and "i+4", or positions "j" and "j+3", e.g., between positions 12 and 16, 16 and 20, 20 and 24, 24 and 28, or 17 and 20. In exemplary embodiments, this covalent bond is a lactam bridge between a glutamic acid at position 16 and a lysine at position 20. In some embodiments, this covalent bond is an intramolecular bridge other than a lactam bridge, as described herein.

Modifications that Reduce Degradation

In yet further exemplary embodiments, any of the Class 2 glucagon related analog peptides can be further modified to improve stability by modifying the amino acid at position 15 and/or 16 of SEQ ID NO: 801 to reduce degradation of the peptide over time, especially in acidic or alkaline buffers. Such modifications reduce cleavage of the Asp15-Ser16 peptide bond. In exemplary embodiments, the amino acid modification at position 15 is a deletion or substitution of Asp with glutamic acid, homoglutamic acid, cysteic acid or homocysteic acid. In other exemplary embodiments, the amino acid modification at position 16 is a deletion or substitution of Ser with Thr or AIB. In other exemplary embodiments, Ser at position 16 is substituted with glutamic acid or with another negatively charged amino acid having a side chain with a length of 4 atoms, or alternatively with any one of glutamine, homoglutamic acid, or homocysteic acid.

In some embodiments, the methionine residue present at position 27 of the native peptide is modified, e.g. by deletion or substitution. Such modifications may prevent oxidative degradation of the peptide. In some embodiments, the Met at position 27 is substituted with leucine, isoleucine or norleucine. In some specific embodiments, Met at position 27 is substituted with leucine or norleucine.

In some embodiments, the Gln at position 20 and/or 24 is modified, e.g. by deletion or substitution. Such modifications can reduce degradation that occurs through deamidation of Gln. In some embodiments, the Gln at position 20 and/or 24 is substituted with Ala or AIB. In some embodiments the Gln at position 20 and/or 24 is substituted with Lys, Arg, Orn, or Citrulline.

In some embodiments, the Asp at position 21 is modified, e.g. by deletion or substitution. Such modifications can reduce degradation that occurs through dehydration of Asp to form a cyclic succinimide intermediate followed by isomerization to iso-aspartate. In some embodiments, position 21 is substituted with Glu, homoglutamic acid or homocysteic acid. In some specific embodiments, position 21 is substituted with Glu.

Stabilization of the Alpha Helix Structure

Stabilization of the alpha-helix structure in the C-terminal portion of the Class 2 glucagon related analog peptide (around amino acids 12-29) provides enhanced GLP-1 and/or GIP activity and restores glucagon activity which has been reduced by amino acid modifications at positions 1 and/or 2. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). Stabilization of the alpha-helix structure of a GIP agonist may be accomplished as described herein.

Acylation and Alkylation

In accordance with some embodiments, the glucagon peptides disclosed herein are modified to comprise an acyl group or alkyl group as described herein. Acylation or alkylation can increase the half-life of the glucagon peptides in circulation. Acylation or alkylation can advantageously delay the onset of action and/or extend the duration of action at the glucagon and/or GLP-1 receptors and/or improve resistance to proteases such as DPP-IV and/or improve solubility. Activity at the glucagon and/or GLP-1 and/or GIP receptors of the glucagon peptide may be maintained after acylation. In some embodiments, the potency of the acylated glucagon peptides is comparable to the unacylated versions of the glucagon peptides. Class 2 glucagon related analog peptides may be acylated or alkylated at the same amino acid position where a hydrophilic moiety is linked, or at a different amino acid position, as described herein.

In some embodiments, the invention provides a glucagon peptide modified to comprise an acyl group or alkyl group covalently linked to the amino acid at position 10 of the glucagon peptide. The glucagon peptide may further comprise a spacer between the amino acid at position 10 of the glucagon peptide and the acyl group or alkyl group. In some embodiments, the acyl group is a fatty acid or bile acid, or salt thereof, e.g. a C4 to C30 fatty acid, a C8 to C24 fatty acid, cholic acid, a C4 to C30 alkyl, a C8 to C24 alkyl, or an alkyl comprising a steroid moiety of a bile acid. The spacer is any moiety with suitable reactive groups for attaching acyl or alkyl groups. In exemplary embodiments, the spacer comprises an amino acid, a dipeptide, or a tripeptide, or a hydrophilic bifunctional spacer. In some embodiments, the spacer is selected from the group consisting of: Trp, Glu, Asp, Cys and a spacer comprising $NH_2(CH_2CH_2O)n(CH_2)mCOOH$, wherein m is any integer from 1 to 6 and n is any integer from 2 to 12. Such acylated or alkylated glucagon peptides may also further comprise a hydrophilic moiety, optionally a polyethylene glycol. Any of the foregoing glucagon peptides may comprise two acyl groups or two alkyl groups, or a combination thereof.

Conjugates and Fusions

The GIP agonist can be linked, optionally via covalent bonding and optionally via a linker, to a conjugate moiety as described herein.

In other embodiments, the second peptide is XGPSSGAP-PPS (SEQ ID NO: 896), wherein X is selected from one of the 20 common amino acids, e.g., glutamic acid, aspartic acid or glycine. In one embodiment X represents an amino acid, for example Cys, that further comprises a hydrophilic moiety covalently linked to the side chain of that amino acid. Such C-terminal extensions improve solubility and also can improve GIP or GLP-1 activity. In some embodiments wherein the glucagon peptide further comprises a carboxy terminal extension, the carboxy terminal amino acid of the extension ends in an amide group or an ester group rather than a carboxylic acid.

In some embodiments, e.g., in glucagon peptides which comprise the C-terminal extension, the threonine at position 29 of the native glucagon peptide is replaced with a glycine. For example, a glucagon peptide having a glycine substitution for threonine at position 29 and comprising the C-terminal extension of GPSSGAPPPS (SEQ ID NO: 895) is four times as potent at the GLP-1 receptor as native glucagon modified to comprise the same C-terminal extension. This T29G substitution can be used in conjunction with other modifications disclosed herein to enhance the affinity of the glucagon peptides for the GLP-1 receptor. For example, the T29G substitution can be combined with the S16E and N20K amino acid substitutions, optionally with a lactam bridge between amino acids 16 and 20, and optionally with addition of a PEG chain as described herein.

In some embodiments an amino acid is added to the C-terminus, and the additional amino acid is selected from the group consisting of glutamic acid, aspartic acid and glycine.

Modifications that Enhance Solubility

In another embodiment, the solubility of any of the glucagon peptides can be improved by amino acid substitutions and/or additions that introduce a charged amino acid into the C-terminal portion of the peptide, preferably at a position C-terminal to position 27 of SEQ ID NO: 801. Optionally, one, two or three charged amino acids may be introduced within the C-terminal portion, preferably C-terminal to position 27. In some embodiments the native amino acid(s) at positions 28 and/or 29 are substituted with one or two charged amino acids, and/or in a further embodiment one to three charged amino acids are also added to the C-terminus of the peptide. In exemplary embodiments, one, two or all of the charged amino acids are negatively charged. In some embodiments, the negatively charged (acidic amino acid) is aspartic acid or glutamic acid.

Additional modifications, e.g. conservative substitutions, may be made to the glucagon peptide that still allow it to retain GIP activity (and optionally GLP-1 activity and/or glucagon activity).

Other Modifications

Any of the modifications described above in reference to a Class 2 peptide which increase or decrease GIP activity, which increase or decrease glucagon receptor activity, and which increase GLP-1 receptor activity can be applied individually or in combination. Any of the modifications described above in reference to a Class 2 glucagon related analog peptide can also be combined with other modifications that confer other desirable properties, such as increased solubility and/or stability and/or duration of action, as described herein with regard to Class 2 glucagon related analog peptides. Alternatively, any of the modifications described above in reference to Class 2 glucaton related peptides can be combined with other modifications described herein in reference to Class 2 glucagon related analog peptides that do not substantially affect solubility or stability or activity. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, within a C-terminal extension, or at the C-terminal amino acid of the peptide, (C) Increasing solubility and/or duration of action or half-life in circulation and/or delaying the onset of action by acylation or alkylation of the glucagon peptide, as described herein;

(D) Increasing duration of action or half-life in circulation through introducing resistance to dipeptidyl peptidase IV (DPP IV) cleavage by modification of the amino acid at position 1 or 2 as described herein.

(E) Increasing stability by modification of the Asp at position 15, for example, by deletion or substitution with glutamic acid, homoglutamic acid, cysteic acid or homocysteic acid. Such modifications can reduce degradation or cleavage at a pH within the range of 5.5 to 8, for example, retaining at least 75%, 80%, 90%, 95%, 96%, 97%, 98% or 99% of the original peptide after 24 hours at 25° C. Such modifications reduce cleavage of the peptide bond between Asp15-Ser16.

(F) Increasing stability by modification of the Ser at position 16, for example by substitution with Thr or AIB. Such modifications also reduce cleavage of the peptide bond between Asp15-Ser16.

(G) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ala or AIB. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(H) Non-conservative or conservative substitutions, additions or deletions that do not substantially affect activity, for example, conservative substitutions at one or more of positions 2, 5, 9, 10, 11, 12, 13, 14, 15, 16, 17, 18, 19, 20, 21, 24, 27, 28 or 29; substitution of one or more of these positions with Ala; deletion of amino acids at one or more of positions 27, 28 or 29; or deletion of amino acid 29 optionally combined with a C-terminal amide or ester in place of the C-terminal carboxylic acid group; substitution of Lys at position 12 with Arg; substitution of Tyr at position 10 with Val or Phe;

Preservation of activity after pegylation is provided by the addition of GPSSGAPPPS (SEQ ID NO: 895) to the C-terminus.

Some positions of the native glucagon peptide can be modified while retaining at least some of the activities of the parent peptide. Accordingly, applicants anticipate that one or more of the amino acids located at positions at positions 2, 5, 10, 11, 12, 13, 14, 17, 18, 19, 20, 21, 24, 27, 28 or 29 can be substituted with an amino acid different from that present in the native glucagon peptide, and still retain activity at the glucagon receptor.

In some embodiments, position 18 is substituted with an amino acid selected from the group consisting of Ala, Ser, or Thr. In some embodiments the amino acid at position 20 is substituted with Lys, Arg, Orn, Citrulline or AIB. In some embodiments, position 21 is substituted with Glu, homoglutamic acid or homocysteic acid. In some embodiments, the glucagon peptide comprises 1 to 10 amino acid modifications selected from positions 16, 17, 18, 20, 21, 23, 24, 27, 28 and 29. In exemplary embodiments, the modifications are one or more amino acid substitutions selected from the group consisting of Gln17, Ala18, Glu21, Ile23, Ala24, Val27 and Gly29. In some embodiments, 1 to 2 amino acids selected from positions 17-26 differ from the parent peptide. In other embodiments, 1 to 2 amino acids selected from positions 17-22 differ from the parent peptide. In yet other embodiments, the modifications are Gln17, Ala18, Glu21, Ile23 and Ala24.

In some embodiments, one or more amino acids is added to the carboxy terminus of the glucagon peptide. The amino acid is typically selected from one of the 20 common amino acids, and in some embodiments the amino acid has an amide group in place of the carboxylic acid of the native amino acid. In exemplary embodiments the added amino acid is selected from the group consisting of glutamic acid and aspartic acid and glycine.

Other modifications that do not destroy activity include W10 or R20.

In some embodiments, the Class 2 glucagon related analog peptides disclosed herein are modified by truncation of the C-terminus by one or two amino acid residues yet retain similar activity and potency at the glucagon, GLP-1 and/or GIP receptors. In this regard, the amino acid at position 29 and/or 28 can be deleted.

Exemplary Embodiments

In some embodiments, the Class 2 glucagon related analog peptide is an analog of glucagon (SEQ ID NO: 801) having GIP agonist activity, with the following modifications:
(a) an amino acid modification at position 1,
(b) (i) a lactam bridge between the side chains of amino acids at positions i and i+4 or between the side chains of amino acids at positions j and j+3, wherein i is 12, 13, 16, 17, 20 or 24, and wherein j is 17, or (ii) an amino acid substitution with an α,α-disubstituted amino acid at one, two, three or all of positions 16, 20, 21, or 24,
(c) amino acid modifications at one, two or all of positions 27, 28 and 29, and
(d) 1, 2, 3, 4, 5, 6, or 8 further amino acid modifications, wherein the EC50 of the analog for GIP receptor activation is about 100 nM or less.

In exemplary embodiments,
(a) the amino acid modification at position 1 is a substitution of His at position 1 with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr,
(b) (i) the lactam bridge is between the amino acids at positions 16 and 20, wherein one of the amino acids at positions 16 and 20 is substituted with Glu, and the other of the amino acids at positions 16 and 20 is substituted with Lys, or (ii) the α,α-disubstituted amino acid is AIB,
(c) the Met at position 27 is substituted with a large aliphatic amino acid, optionally Leu,
(d) the Asn at position 28 is substituted with a small aliphatic amino acid, optionally Ala, and
(e) the Thr at position 29 is substituted with a small aliphatic amino acid, optionally Gly.

The analog may comprise further modifications, including without limitation:
(a) amino acid modification at position 12, optionally substitution with Ile,
(b) amino acid modifications at positions 17 and 18, optionally substitution with Q at position 17 and A at position 18,
(c) addition of GPSSGAPPPS (SEQ ID NO: 895) to the C-terminus, or any combination thereof.

The analog may alternatively or in addition comprise further modifications, including without limitation:
(a) Ser at position 2 substituted with D-Ser, Ala, D-Ala, Gly, N-methyl-Ser, AIB, Val, or amino-isobutyric acid;
(b) Tyr at position 10 substituted with Trp, Lys, Orn, Glu, Phe, or Val;
(c) Linkage of an acyl group to a Lys at position 10;
(d) Lys at position 12 substituted with Arg;
(e) Ser at position 16 substituted with Glu, Gln, homoglutamic acid, homocysteic acid, Thr, Gly, or AIB;

(f) Arg at position 17 substituted with Gln, Lys or Glu;
(g) Arg at position 18 substituted with Ala, Ser, Thr, or Gly;
(h) Gln at position 20 substituted with Ala, Lys, Citrulline, Arg, Orn, or AIB;
(i) Asp at position 21 substituted with Glu, homoglutamic acid, homocysteic acid;
(j) Val at position 23 substituted with Ile;
(k) Gln at position 24 substituted with Asn, Ala, Glu, Lys, or AIB; and
(l) a conservative substitution at any of positions 2, 5, 9, 10, 11, 12, 13, 14, 15, 16, 17, 18, 19, 20, 21, 24, 27, 28, and 29, or any combination thereof.

In some embodiments, the Class 2 glucagon related analog peptide is covalently linked to a hydrophilic moiety at any of amino acid positions 16, 17, 20, 21, 24, or 29, after position 29 at an added amino acid (e.g., position 30) within a C-terminal extension, or at the C-terminal amino acid. In exemplary embodiments, this hydrophilic moiety is covalently linked to a Lys, Cys, Orn, homocysteine, or acetyl-phenylalanine residue at any of these positions. Exemplary hydrophilic moieties include polyethylene glycol (PEG), for example, of a molecular weight of about 1,000 Daltons to about 40,000 Daltons, or about 20,000 Daltons to about 40,000 Daltons.

The GIP agonist may be a peptide comprising the amino acid sequence of any of the amino acid sequences, e.g., SEQ ID NOs: 805-894, optionally with up to 1, 2, 3, 4, or 5 further modifications that retain GIP agonist activity.

Class 3 Glucagon Related Analog Peptides

In certain embodiments, the glucagon related analog peptide is a Class 3 glucagon related analog peptide, which is described herein and in International Patent Application Publication No. WO 2008/101017, published on Aug. 21, 2008, and U.S. Provisional Application No. 61/090,412, the contents of which are incorporated by reference in their entirety.

Activity

The Class 3 glucagon related analog peptide can be a peptide that exhibits increased activity at the glucagon receptor, and in further embodiments exhibits enhanced biophysical stability and/or aqueous solubility. In addition, in one embodiment, the Class 3 glucagon related analog peptide has lost native glucagon's selectivity for the glucagon receptor verses the GLP-1 receptor, and thus represents co-agonists of those two receptors. Selected amino acid modifications within the Class 3 glucagon related analog peptide can control the relative activity of the peptide at the GLP-1 receptor verses the glucagon receptor. Thus, the Class 3 glucagon related analog peptide can be a glucagon/GLP-1 co-agonist that has higher activity at the glucagon receptor versus the GLP-1 receptor, a glucagon/GLP-1 co-agonist that has approximately equivalent activity at both receptors, or a glucagon/GLP-1 co-agonist that has higher activity at the GLP-1 receptor versus the glucagon receptor. The latter category of co-agonist can be engineered to exhibit little or no activity at the glucagon receptor, and yet retain ability to activate the GLP-1 receptor with the same or better potency than native GLP-1. Any of these co-agonists may also include modifications that confer enhanced biophysical stability and/or aqueous solubility.

Modifications of the Class 3 glucagon related analog peptide can be made to produce a glucagon peptide having anywhere from at least about 10% (including at least about 20%, 30%, 40%, 50%, 60%, 75%, 100%, 125%, 150%, 175%) to about 200% or higher activity at the GLP-1 receptor relative to native GLP-1 and anywhere from at least about 10% (including about 20%, 30%, 40%, 50%, 60%, 75%, 100%, 125%, 150%, 175%, 200%, 250%, 300%, 350%, 400%, 450%) to about 500% or higher activity at the glucagon receptor relative to native glucagon. The amino acid sequence of native glucagon is SEQ ID NO: 1, the amino acid sequence of GLP-1(7-36)amide is SEQ ID NO: 52, and the amino acid sequence of GLP-1(7-37)acid is SEQ ID NO: 50. In exemplary embodiments, a Class 3 glucagon related analog peptide may exhibit at least 10% of the activity of native glucagon at the glucagon receptor and at least 50% of the activity of native GLP-1 at the GLP-1 receptor, or at least 40% of the activity of native glucagon at the glucagon receptor and at least 40% of the activity of native GLP-1 at the GLP-1 receptor, or at least 60% of the activity of native glucagon at the glucagon receptor and at least 60% of the activity of native GLP-1 at the GLP-1 receptor.

Selectivity of a Class 3 glucagon related analog peptide for the glucagon receptor versus the GLP-1 receptor can be described as the relative ratio of glucagon/GLP-1 activity (the peptide's activity at the glucagon receptor relative to native glucagon, divided by the peptide's activity at the GLP-1 receptor relative to native GLP-1). For example, a Class 3 glucagon related analog peptide that exhibits 60% of the activity of native glucagon at the glucagon receptor and 60% of the activity of native GLP-1 at the GLP-1 receptor has a 1:1 ratio of glucagon/GLP-1 activity. Exemplary ratios of glucagon/GLP-1 activity include about 1:1, 1.5:1, 2:1, 3:1, 4:1, 5:1, 6:1, 7:1, 8:1, 9:1 or 10:1, or about 1:10, 1:9, 1:8, 1:7, 1:6, 1:5, 1:4, 1:3, 1:2, or 1:1.5. As an example, a glucagon/GLP-1 activity ratio of 10:1 indicates a 10-fold selectivity for the glucagon receptor versus the GLP-1 receptor. Similarly, a GLP-1/glucagon activity ratio of 10:1 indicates a 10-fold selectivity for the GLP-1 receptor versus the glucagon receptor.

In some embodiments, the Class 3 glucagon related analog peptides have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary Class 3 glucagon related analog peptides described herein have about 0.5%, about 1% or about 7% of the activity of native glucagon, while exhibiting at least 20% of the activity of GLP-1 at the GLP-1 receptor.

The Class 3 glucagon related analog peptide can be a glucagon peptide with increased or decreased activity at the glucagon receptor, or GLP-1 receptor, or both. The Class 3 glucagon related analog peptide can be a glucagon peptide with altered selectivity for the glucagon receptor versus the GLP-1 receptor.

Thus, as disclosed herein high potency Class 3 glucagon related analog peptides are provided that also exhibit improved solubility and/or stability. An exemplary high potency Class 3 glucagon related analog peptide exhibits at least about 200% of the activity of native glucagon at the glucagon receptor, and optionally is soluble at a concentration of at least 1 mg/mL at a pH between 6 and 8, or between 6 and 9, or between 7 and 9 (e.g. pH 7), and optionally retains at least 95% of the original peptide (e.g. 5% or less of the original peptide is degraded or cleaved) after 24 hours at 25° C. As another example, an exemplary Class 3 glucagon related analog peptide exhibits greater than about 40% or greater than about 60% activity at both the glucagon and the GLP-1 receptors (at a ratio between about 1:3 and 3:1, or between about 1:2 and 2:1), is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Another exemplary Class 3 glucagon related analog peptide exhibits about 175% or more of the activity of native glucagon at the glucagon receptor and about 20% or less of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Yet another exemplary Class 3 glucagon related analog peptide exhibits about 10% or less of the activity of native glucagon at the glucagon receptor and at least about 20% of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Yet another exemplary Class 3 glucagon related analog peptide exhibits about 10% or less but above 0.1%, 0.5% or 1% of the activity of native glucagon at the glucagon receptor and at least about 50%, 60%, 70%, 80%, 90% or 100% or more of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. In some embodiments, such Class 3 glucagon related analog peptides retain at least 22, 23, 24, 25, 26, 27 or 28 of the naturally occurring amino acids at the corresponding positions in native glucagon (e.g. have 1-7, 1-5 or 1-3 modifications relative to naturally occurring glucagon).

Modifications Affecting Glucagon Activity

Increased activity at the glucagon receptor is provided by an amino acid modification at position 16 of native glucagon (SEQ ID NO: 1). In one embodiment, the Class 3 glucagon related analog peptide is a glucagon agonist that has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 1) to enhance the peptide's potency at the glucagon receptor. The normally occurring serine at position 16 of native glucagon (SEQ ID NO: 1) can be substituted with select acidic amino acids to enhance the potency of glucagon, in terms of its ability to stimulate cAMP synthesis in a validated in vitro model assay (see Example 2). More particularly, this substitution enhances the potency of the analog at least 2-fold, 4-fold, 5-fold, and up to 10-fold greater at the glucagon receptor. This substitution also enhances the analog's activity at the GLP-1 receptor at least 5-fold, 10-fold, or 15-fold relative to native glucagon, but selectivity is maintained for the glucagon receptor over the GLP-1 receptor.

By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In accordance with one embodiment, the serine residue at position 16 of native glucagon is substituted with an amino acid selected from the group consisting of glutamic acid, glutamine, homoglutamic acid, homocysteic acid, threonine, or glycine. In accordance with one embodiment, the serine residue at position 16 of native glucagon is substituted with an amino acid selected from the group consisting of glutamic acid, glutamine, homoglutamic acid and homocysteic acid, and in one embodiment the serine residue is substituted with glutamic acid.

In one embodiment, the enhanced potency Class 3 glucagon related analog peptide comprises a peptide of SEQ ID NO: 2, SEQ ID NO: 3, SEQ ID NO: 4, SEQ ID NO: 5, SEQ ID NO: 6, SEQ ID NO: 7 or a glucagon agonist analog of SEQ ID NO: 5. In accordance with one embodiment, a Class 3 glucagon related analog peptide having enhanced potency at the glucagon receptor relative to wild type glucagon is provided wherein the peptide comprises the sequence of SEQ ID NO: 7, SEQ ID NO: 8, SEQ ID NO: 9 or SEQ ID NO: 10, wherein the glucagon peptide retains its selectivity for the glucagon receptor relative to the GLP-1 receptors. In one embodiment, the Class 3 glucagon related analog peptide having enhanced specificity for the glucagon receptor comprises the peptide of SEQ ID NO: 8, SEQ ID NO: 9, SEQ ID NO: 10 or a glucagon agonist analog thereof, wherein the carboxy terminal amino acid retains its native carboxylic acid group. In accordance with one embodiment, a Class 3 glucagon related analog peptide comprises the sequence of $NH_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-COOH (SEQ ID NO: 10), wherein the peptide exhibits approximately fivefold enhanced potency at the glucagon receptor, relative to native glucagon as measured by the in vitro cAMP assay of Example 2.

Reduced activity at the glucagon receptor is provided, e.g., by an amino acid modification at position 3. Substitution at this position with an acidic, basic, or a hydrophobic amino acid (glutamic acid, ornithine, norleucine) has been shown to substantially reduce or destroy glucagon receptor activity. In particular, any of the Class 3 glucagon related analog peptides, including glucagon analogs, glucagon agonist analogs, glucagon co-agonists, and glucagon/GLP-1 co-agonist molecules, described herein may be modified to contain a modification at position 3, e.g., Gln substituted with Glu, to produce a peptide with high selectivity, e.g., tenfold selectivity, for the GLP-1 receptor as compared to the selectivity for the glucagon receptor.

It was observed that modifications at position 2 (e.g. AIB at position 2) and in some cases modifications at position 1 may reduce glucagon activity. This reduction in glucagon activity can be restored by stabilizing the alpha-helix in the C-terminal portion of glucagon, e.g. through means described herein, for example, through a covalent bond between amino acids at positions "i" and "i+4", e.g., 12 and 16, 16 and 20, or 20 and 24. In some embodiments, this covalent bond is a lactam bridge between a glutamic acid at position 16 and a lysine at position 20. In some embodiments, this covalent bond is an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization.

Modifications Affecting GLP-1 Activity

Enhanced activity at the GLP-1 receptor is provided by replacing the carboxylic acid of the C-terminal amino acid with a charge-neutral group, such as an amide or ester. In one embodiment, these Class 3 glucagon related analog peptides comprise a sequence of SEQ ID NO: 20, wherein the carboxy terminal amino acid has an amide group in place of the carboxylic acid group found on the native amino acid. These Class 3 glucagon related analog peptides have strong activity at both the glucagon and GLP-1 receptors and thus act as co-agonists at both receptors. In accordance with one embodiment, the Class 3 glucagon related analog peptide is a glucagon and GLP-1 receptor co-agonist, wherein the peptide comprises the sequence of SEQ ID NO: 20, wherein the amino acid at position 28 is Asn or Lys and the amino acid at position 29 is Thr-amide.

Increased activity at the GLP-1 receptor is provided by modifications that stabilize the alpha helix in the C-terminal portion of glucagon (e.g. around residues 12-29).

In some embodiments, such modifications permit formation of an intramolecular bridge between the side chains of two amino acids that are separated by three intervening amino acids (i.e., an amino acid at position "i" and an amino acid at position "i+4", wherein i is any integer between 12 and 25), by two intervening amino acids, i.e., an amino acid at position "j" and an amino acid at position "j+3," wherein j is any integer between 12 and 27, or by six intervening amino acids, i.e., an amino acid at position "k" and an amino acid at position "k+7," wherein k is any integer between 12 and 22. In exemplary embodiments, the bridge or linker is about 8 (or about 7-9) atoms in length and forms between side chains of amino acids at positions 12 and 16, or at positions 16 and 20, or at positions 20 and 24, or at positions 24 and 28. The two amino acid side chains can be linked to one another through hydrogen-bonding, ionic interactions, such as the formation of salt bridges, or by covalent bonds.

In accordance with one embodiment, the Class 3 glucagon related analog peptide exhibits glucagon/GLP-1 receptor co-agonist activity and comprises an amino acid sequence selected from the group consisting of SEQ ID NO: 11, 47, 48 and 49. In one embodiment, the side chains are covalently bound to one another, and in one embodiment the two amino acids are bound to one another to form a lactam ring.

In accordance with one embodiment, the Class 3 glucagon related analog peptide comprises SEQ ID NO: 45, wherein at least one lactam ring is formed between the side chains of an amino acid pair selected from the group consisting of amino acid pairs 12 and 16, 16 and 20, 20 and 24 or 24 and 28. In one embodiment, the Class 3 glucagon related analog peptide comprises a glucagon peptide analog of SEQ ID NO: 20, wherein the peptide comprises an intramolecular lactam bridge formed between amino acid positions 12 and 16 or between amino acid positions 16 and 20. In one embodiment, the Class 3 glucagon related analog peptide comprises the sequence of SEQ ID NO: 20, wherein an intramolecular lactam bridge is formed between amino acid positions 12 and 16, between amino acid positions 16 and 20, or between amino acid positions 20 and 24 and the amino acid at position 29 is glycine, wherein the sequence of SEQ ID NO: 29 is linked to the C-terminal amino acid of SEQ ID NO: 20. In a further embodiment, the amino acid at position 28 is aspartic acid.

In some specific embodiments, stabilization of the alpha helix structure in the C-terminal portion of the Class 3 glucagon related analog peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of a, co-diaminoalkane tethers, the formation of metal-atom bridges, and other means of peptide cyclization are used to stabilize the alpha helix.

Furthermore, enhanced activity at the GLP-1 receptor may be achieved by stabilizing the alpha-helix structure in the C-terminal portion of the glucagon peptide (around amino acids 12-29) through introduction of one or more α,α-disubstituted amino acids at positions that retain the desired activity. In some aspects, stabilization of the alpha-helix is accomplished in this manner without introduction of an intramolecular bridge such as a salt bridge or covalent bond.

In some embodiments, one, two, three, four or more of positions 16, 17, 18, 19, 20, 21, 24 or 29 of a glucagon peptide is substituted with an α,α-disubstituted amino acid. For example, substitution of position 16 of the Class 3 glucagon related analog peptide with amino iso-butyric acid (AIB) enhances GLP-1 activity, in the absence of a salt bridge or lactam. In some embodiments, one, two, three or more of positions 16, 20, 21 or 24 are substituted with AIB.

Enhanced activity at the GLP-1 receptor may be achieved by an amino acid modification at position 20. In one embodiment, the glutamine at position 20 is replaced with another hydrophilic amino acid having a side chain that is either charged or has an ability to hydrogen-bond, and is at least about 5 (or about 4-6) atoms in length, for example, lysine, citrulline, arginine, or ornithine.

Increased activity at the GLP-1 receptor is demonstrated in Class 3 glucagon related analog peptides comprising the C-terminal extension of SEQ ID NO: 26. GLP-1 activity in such Class 3 glucagon related analog peptides comprising SEQ ID NO: 26 can be further increased by modifying the amino acid at position 18, 28 or 29, or at position 18 and 29, as described herein.

A further modest increase in GLP-1 potency may be achieved by modifying the amino acid at position 10 to be Trp.

Combinations of the modifications that increase GLP-1 receptor activity generally provide higher GLP-1 activity than any of such modifications taken alone. For example, the Class 3 glucagon related analog peptides can comprise modifications at position 16, at position 20, and at the C-terminal carboxylic acid group, optionally with a covalent bond between the amino acids at positions 16 and 20; can comprise modifications at position 16 and at the C-terminal carboxylic acid group; can comprise modifications at positions 16 and 20, optionally with a covalent bond between the amino acids at positions 16 and 20; or can comprise modifications at position 20 and at the C-terminal carboxylic acid group; optionally with the proviso that the amino acid at position 12 is not Arg; or optionally with the proviso that the amino acid at position 9 is not Glu.

Modifications Affecting Solubility
Addition of Hydrophilic Moieties

The Class 3 glucagon related analog peptides can be further modified to improve the peptide's solubility and stability in aqueous solutions at physiological pH, while retaining the high biological activity relative to native glucagon. Hydrophilic moieties as discussed herein can be attached to the Class 3 glucagon related analog peptide as further discussed herein.

In accordance with one embodiment, introduction of hydrophilic groups at positions 17, 21, and 24 of the Class 3 glucagon related analog peptide comprising SEQ ID NO: 9 or SEQ ID NO: 10 are anticipated to improve the solubility and stability of the high potency glucagon analog in solutions having a physiological pH. Introduction of such groups also increases duration of action, e.g. as measured by a prolonged half-life in circulation.

In one embodiment, the Class 3 glucagon related analog peptide comprises a sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18 and SEQ ID NO: 19, wherein the side chain of an amino acid residue at one of position 16, 17, 21 or 24 of said Class 3 glucagon related analog peptide further comprises a polyethylene glycol chain, having a molecular weight selected from the range of about 500 to about 40,000 Daltons. In one embodiment, the polyethylene glycol chain has a molecular weight selected from the range of about 500 to about 5,000 Daltons. In another embodiment. the polyethylene glycol chain has a molecular weight of about 10,000 to about 20,000 Daltons. In yet other exemplary embodiments the polyethylene glycol chain has a molecular weight of about 20,000 to about 40,000 Daltons.

Suitable hydrophilic moieties include any water soluble polymers known in the art, including the hydrophilic moieties described herein, homo- or co-polymers of PEG, and a monomethyl-substituted polymer of PEG (mPEG). In accordance with one embodiment the hydrophilic group comprises a polyethylene (PEG) chain. More particularly, in one embodiment, the Class 3 glucagon related analog peptide comprises the sequence of SEQ ID NO: 6 or SEQ ID NO: 7 wherein a PEG chain is covalently linked to the side chains of amino acids present at positions 21 and 24 of the Class 3 glucagon related analog peptide and the carboxy terminal amino acid of the Class 3 glucagon related analog peptide has the carboxylic acid group. In accordance with one embodiment, the polyethylene glycol chain has an average molecular weight selected from the range of about 500 to about 10,000 Daltons.

In accordance with one embodiment, the pegylated Class 3 glucagon related analog peptide comprises two or more polyethylene chains covalently bound to the Class 3 glucagon related analog peptide wherein the total molecular weight of the glucagon chains is about 1,000 to about 5,000 Daltons. In one embodiment the pegylated glucagon agonist comprises a peptide consisting of SEQ ID NO: 5 or a glucagon agonist analog of SEQ ID NO: 5, wherein a PEG chain is covalently linked to the amino acid residue at position 21 and at position 24, and wherein the combined molecular weight of the two PEG chains is about 1,000 to about 5,000 Daltons.

Charged C-Terminus

The solubility of the Class 3 glucagon related analog peptide comprising SEQ ID NO: 20 can be further improved, for example, by introducing one, two, three or more charged amino acid(s) to the C-terminal portion of glucagon peptide of SEQ ID NO: 20, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. Additional modifications, e.g. conservative substitutions, may be made to the Class 3 glucagon related analog peptide that still allow it to retain glucagon activity. In one embodiment, an analog of the Class 3 glucagon related analog peptide of SEQ ID NO: 20 is provided wherein the analog differs from SEQ ID NO: 20 by 1 to 2 amino acid substitutions at positions 17-26, and, in one embodiment, the analog differs from the peptide of SEQ ID NO: 20 by an amino acid substitution at position 20.

Acylation/Alkylation

In accordance with one embodiment, the glucagon peptide is modified to comprise an acyl group, to prolong half-life in circulation and/or delay the onset of and/or extend the duration of action and/or improve resistance to proteases such as DPP-IV. The activity at the glucagon receptor and GLP-1 receptor of the Class 3 glucagon related analog peptides is maintained after acylation. Further, the potency of the acylated analogs were comparable to the unacylated versions of the Class 3 glucagon related analog peptides.

In some embodiments, the invention provides a Class 3 glucagon related analog peptide modified to comprise an acyl group or alkyl group covalently linked to the amino acid at position 10 of the glucagon peptide. The glucagon peptide may further comprise a spacer between the amino acid at position 10 of the Class 3 glucagon related analog peptide and the acyl group or alkyl group. Any of the foregoing Class 3 glucagon related analog peptides may comprise two acyl groups or two alkyl groups, or a combination thereof.

In a specific aspect of the invention, the acylated Class 3 glucagon related analog peptide comprises the amino acid sequence of any of SEQ ID NOs: 534-544 and 546-549.

C-Terminal Truncation

In some embodiments, the Class 3 glucagon related analog peptides described herein are further modified by truncation or deletion of one or two amino acids of the C-terminus of the glucagon peptide (i.e., position 29 and/or 28) without affecting activity and/or potency at the glucagon and GLP-1 receptors. In this regard, the Class 3 glucagon related analog peptide can comprise amino acids 1-27 or 1-28 of the native glucagon peptide (SEQ ID NO: 1), optionally with one or more modifications described herein.

In one embodiment, the truncated Class 3 glucagon related analog peptide comprises SEQ ID NO: 550 or SEQ ID NO: 551. In another embodiment, the truncated glucagon agonist peptide comprises SEQ ID NO: 552 or SEQ ID NO: 553.

C-Terminal Extension

In accordance with one embodiment, the Class 3 glucagon related analog peptides disclosed herein are modified by the addition of a second peptide to the carboxy terminus of the glucagon peptide, for example, SEQ ID NO: 26, SEQ ID NO: 27 or SEQ ID NO: 28. In one embodiment, a Class 3 glucagon related analog peptide having a sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 66, SEQ ID NO: 67, SEQ ID NO: 68, and SEQ ID NO: 69 is covalently bound through a peptide bond to a second peptide, wherein the second peptide comprises a sequence selected from the group consisting of SEQ ID NO: 26, SEQ ID NO: 27 and SEQ ID NO: 28. In a further embodiment, in Class 3 glucagon related analog peptides which comprise the C-terminal extension, the threonine at position 29 of the native glucagon peptide is replaced with a glycine. A Class 3 glucagon related analog peptide having a glycine substitution for threonine at position 29 and comprising the carboxy terminal extension of SEQ ID NO: 26 is four times as potent at the GLP-1 receptor as native glucagon modified to comprise the carboxy terminal extension of SEQ ID NO: 26. Potency at the GLP-1 receptor can be further enhanced by an alanine substitution for the native arginine at position 18.

Accordingly, the Class 3 glucagon related analog peptide can have a carboxy terminal extension of SEQ ID NO: 27 (KRNRNNIA) or SEQ ID NO: 28. In accordance with one embodiment, Class 3 glucagon related analog peptide comprising SEQ ID NO: 33 or SEQ ID NO: 20, further comprises the amino acid sequence of SEQ ID NO: 27 (KRNRNNIA) or SEQ ID NO: 28 linked to amino acid 29 of the glucagon peptide. More particularly, the Class 3 glucagon related analog peptide comprises a sequence selected from the group consisting of SEQ ID NO: 10, SEQ ID NO: 12, SEQ ID NO: 13 SEQ ID NO: 14 and SEQ ID NO: 15, further comprising the amino acid sequence of SEQ ID NO: 27 (KRNRNNIA) or SEQ ID NO: 28 linked to amino acid 29 of the glucagon peptide. More particularly, the glucagon peptide comprises a sequence selected from the group consisting of SEQ ID NO: 10, SEQ ID NO: 12, SEQ ID NO: 13 SEQ ID NO: 14, SEQ ID NO: 15, SEQ ID NO: 16, SEQ ID NO: 17, SEQ ID NO: 18, SEQ ID NO: 66, SEQ ID NO: 67, SEQ ID NO: 68, SEQ ID NO: 69, SEQ ID NO: 55 and SEQ ID NO: 56 further comprising the amino acid sequence of SEQ ID NO: 26 (GPSS- GAPPPS) or SEQ ID NO: 29 linked to amino acid 29 of the Class 3 glucagon related analog peptide. In one embodiment, the Class 3 glucagon related analog peptide comprises the sequence of SEQ ID NO: 64.

Other Modifications

Any of the modifications described above with regard to Class 3 glucagon related analog peptides which increase or decrease glucagon receptor activity and which increase GLP-1 receptor activity can be applied individually or in combination. Combinations of the modifications that increase GLP-1 receptor activity generally provide higher GLP-1 activity than any of such modifications taken alone. Any of the modifications described above can also be combined with other modifications described herein in reference to Class 3 glucagon related analog peptides that confer other desirable properties, such as increased solubility and/or stability and/or duration of action. Alternatively, any of the modifications described above can be combined with other modifications described herein in reference to Class 3 glucagon related analog peptides that do not substantially affect solubility or stability or activity. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, or at the C-terminal amino acid of the peptide.

(C) Increasing stability by modification of the aspartic acid at position 15, for example, by deletion or substitution with glutamic acid, homoglutamic acid, cysteic acid or homocysteic acid. Such modifications can reduce degradation or cleavage at a pH within the range of 5.5 to 8, especially in acidic or alkaline buffers, for example, retaining at least 75%, 80%, 90%, 95%, 96%, 97%, 98% or 99% of the original peptide after 24 hours at 25° C.

(D) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ala or AIB. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(E) Increasing resistance to dipeptidyl peptidase IV (DPP IV) cleavage by modification of the amino acid at position 1 or 2 with the DPP-IV resistant amino acids described herein and including modification of the amino acid at position 2 with N-methyl-alanine.

(F) Conservative or non-conservative substitutions, additions or deletions that do not affect activity, for example, conservative substitutions at one or more of positions 2, 5, 7, 10, 11, 12, 13, 14, 16, 17, 18, 19, 20, 21, 24, 27, 28 or 29; deletions at one or more of positions 27, 28 or 29; or a deletion of amino acid 29 optionally combined with a C-terminal amide or ester in place of the C-terminal carboxylic acid group;

(G) Adding C-terminal extensions as described herein;

(H) Increasing half-life in circulation and/or extending the duration of action and/or delaying the onset of action, for example, through acylation or alkylation of the glucagon peptide, as described herein;

(I) Homodimerization or heterodimerization as described herein.

Other modifications include substitution of His at position 1 with a large, aromatic amino acid (e.g., Tyr, Phe, Trp or amino-Phe); Ser at position 2 with Ala; substitution of Tyr at position 10 with Val or Phe; substitution of Lys at position 12 with Arg; substitution of Asp at position 15 with Glu; substitution of Ser at position 16 with Thr or AIB.

Class 3 glucagon related analog peptides with GLP-1 activity that contain a non-conservative substitution of His at position 1 with a large, aromatic amino acid (e.g., Tyr) can retain GLP-1 activity provided that the alpha-helix is stabilized via an intramolecular bridge, e.g., such as any of those described herein.

Conjugates and Fusions

The Class 3 glucagon related analog peptide can be linked, optionally via covalent bonding and optionally via a linker, to a conjugate moiety.

The Class 3 glucagon related analog peptide also can be part of a fusion peptide or protein wherein a second peptide or polypeptide has been fused to a terminus, e.g., the carboxy terminus of the Class 3 glucagon related analog peptide.

More particularly, the fusion Class 3 glucagon related analog peptide may comprise a glucagon agonist of SEQ ID NO: 55, SEQ ID NO: 9 or SEQ ID NO: 10 further comprising an amino acid sequence of SEQ ID NO: 26 (GPSSGAPPPS), SEQ ID NO: 27 (KRNRNNIA) or SEQ ID NO: 28 (KRNR) linked to amino acid 29 of the glucagon peptide. In one embodiment, the amino acid sequence of SEQ ID NO: 26 (GPSSGAPPPS), SEQ ID NO: 27 (KRNRNNIA) or SEQ ID NO: 28 (KRNR) is bound to amino acid 29 of the Class 3 glucagon related analog peptide through a peptide bond. Applicants have discovered that in Class 3 glucagon related analog peptide fusion peptides comprising the C-terminal extension peptide of Exendin-4 (e.g., SEQ ID NO: 26 or SEQ ID NO: 29), substitution of the native threonine residue at position 29 with glycine dramatically increases GLP-1 receptor activity. This amino acid substitution can be used in conjunction with other modifications disclosed herein with regard to Class 3 glucagon related analog peptides to enhance the affinity of the glucagon analogs for the GLP-1 receptor. For example, the T29G substitution can be combined with the S16E and N20K amino acid substitutions, optionally with a lactam bridge between amino acids 16 and 20, and optionally with addition of a PEG chain as described herein. In one embodiment, a Class 3 glucagon related analog peptide comprises the sequence of SEQ ID NO: 64. In one embodiment, the Class 3 glucagon related analog peptide portion of the glucagon fusion peptide is selected from the group consisting of SEQ ID NO: 55, SEQ ID NO: 2, SEQ ID NO: 3, SEQ ID NO: 4, and SEQ ID NO: 5 wherein a PEG chain, when present at positions 17, 21, 24, or the C-terminal amino acid, or at both 21 and 24, is selected from the range of 500 to 40,000 Daltons. More particularly, in one embodiment, the Class 3 glucagon related analog peptide segment is selected from the group consisting of SEQ ID NO: 7, SEQ ID NO: 8, and SEQ ID NO: 63, wherein the PEG chain is selected from the range of 500 to 5,000. In one embodiment, the Class 3 glucagon related analog peptide is a fusion peptide comprising the sequence of SEQ ID NO: 55 and SEQ ID NO: 65 wherein the peptide of SEQ ID NO: 65 is linked to the carboxy terminus of SEQ ID NO: 55.

In accordance with one embodiment, an additional chemical modification of the Class 3 glucagon related analog peptide of SEQ ID NO: 10 bestows increased GLP-1 receptor potency to a point where the relative activity at the glucagon and GLP-1 receptors is virtually equivalent. Accordingly, in one embodiment, a Class 3 glucagon related analog peptide comprises a terminal amino acid comprising an amide group in place of the carboxylic acid group that is present on the native amino acid. The relative activity of the Class 3 glucagon related analog peptide at the respective glucagon and GLP-1 receptors can be adjusted by further modifications to the Class 3 glucagon related analog peptide to produce analogs demonstrating about 40% to about 500% or more of the activity of native glucagon at the glucagon receptor and about 20% to about 200% or more of the activity of native GLP-1 at the GLP-1 receptor, e.g. 50-fold, 100-fold or more increase relative to the normal activity of glucagon at the GLP-1 receptor.

Exemplary Embodiments

In accordance with one embodiment, a Class 3 glucagon related analog peptide is an analog of SEQ ID NO: 55, wherein said analog differs from SEQ ID NO: 55 by 1 to 3 amino acids, selected from positions 1, 2, 3, 5, 7, 10, 11, 13, 14, 17, 18, 19, 21, 24, 27, 28, and 29, wherein said Class 3 glucagon related analog peptide exhibits at least 20% of the activity of native GLP-1 at the GLP-1 receptor.

In accordance with one embodiment, the Class 3 glucagon related analog peptide comprises the sequence: NH$_2$-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 33) wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH or CONH$_2$, with the proviso that when position 16 is serine, position 20 is Lys, or alternatively when position 16 is serine the position 24 is Glu and either position 20 or position 28 is Lys. In one embodiment, the Class 3 glucagon related analog peptide comprises the sequence of SEQ ID NO: 33 wherein the amino acid at position 28 is aspartic acid and the amino acid at position 29 is glutamic acid. In another embodiment, the amino acid at position 28 is the native asparagine, the amino acid at position 29 is glycine and the amino acid sequence of SEQ ID NO: 29 or SEQ ID NO: 65 is covalently linked to the carboxy terminus of SEQ ID NO: 33.

In one embodiment, the Class 3 glucagon related analog peptide comprises the sequence of SEQ ID NO: 33 wherein an additional acidic amino acid added to the carboxy terminus of the peptide. In a further embodiment the carboxy terminal amino acid of the Class 3 glucagon related analog peptide has an amide in place of the carboxylic acid group of the natural amino acid. In one embodiment the Class 3 glucagon related analog peptide comprises a sequence selected from the group consisting of SEQ ID NO: 40, SEQ ID NO: 41, SEQ ID NO: 42, SEQ ID NO: 43 and SEQ ID NO: 44.

In accordance with one embodiment, the Class 3 glucagon related analog peptide is an analog comprising SEQ ID NO: 33, wherein said analog differs from SEQ ID NO: 33 by 1 to 3 amino acids, selected from positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28. In accordance with one embodiment, the analog differs from SEQ ID NO: 33 by 1 to 3 amino acids selected from positions 1, 2, 3, 21 and 27. In one embodiment, the glucagon peptide analog of SEQ ID NO: 33 differs from that sequence by 1 to 2 amino acids, or in one embodiment by a single amino acid, selected form positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28.

In accordance with another embodiment, the Class 3 glucagon related analog peptide is a relatively selective GLP-1 receptor agonist comprising the sequence NH$_2$-His-Ser-Xaa-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 53) wherein the Xaa at position 3 is selected from the group of amino acids consisting of Glu, Orn or Nle, the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH, CONH$_2$, SEQ ID NO: 26 or SEQ ID NO: 29, with the proviso that when position 16 is serine, position 20 is Lys, or alternatively when position 16 is serine the position 24 is Glu and either position 20 or position 28 is Lys. In one embodiment, the amino acid at position 3 is glutamic acid. In one embodiment, the acidic amino acid substituted at position 28 and/or 29 is aspartic acid or glutamic acid. In one embodiment, the Class 3 glucagon related analog peptide comprises the sequence of SEQ ID NO: 33 further comprising an additional acidic amino acid added to the carboxy terminus of the peptide. In a further embodiment the carboxy terminal amino acid of the Class 3 glucagon related analog peptide has an amide in place of the carboxylic acid group of the natural amino acid.

In accordance with one embodiment, the Class 3 glucagon related analog peptide comprises a modified glucagon peptide selected from the group consisting of: NH$_2$-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 34), wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu and the Xaa at position 28 is Asn, Asp or Lys, R is COOH or CONH$_2$, the Xaa at position 29 is Thr or Gly, and R is COOH, CONH$_2$, SEQ ID NO: 26 or SEQ ID NO: 29, with the proviso that when position 16 is serine, position 20 is Lys, or alternatively when position 16 is serine the position 24 is Glu and either position 20 or position 28 is Lys. In one embodiment, R is CONH$_2$, the Xaa at position 15 is Asp, the Xaa at position 16 is selected from the group of amino acids consisting of Glu, Gln, homoglutamic acid and homocysteic acid, the Xaas at positions 20 and 24 are each Gln the Xaa at position 28 is Asn or Asp and the Xaa at position 29 is Thr. In one embodiment, the Xaa's at positions 15 and 16 are each Glu, the Xaas at positions 20 and 24 are each Gln, the Xaa at position 28 is Asn or Asp, the Xaa at position 29 is Thr and R is CONH$_2$.

In accordance with one embodiment, the Class 3 glucagon related analog peptide has enhanced GLP-1 activity and comprises (a) an amino acid substitution of His at position 1 with a large, aromatic amino acid and (b) an intramolecular bridge that stabilizes that alpha-helix in the C-terminal portion of the molecule (e.g. around positions 12-29). In a specific embodiment, the amino acid at position 1 is Tyr, Phe, Trp, amino-Phe, nitro-Phe, chloro-Phe, sulfo-Phe, 4-pyridyl-Ala, methyl-Tyr, or 3-amino Tyr. In a specific aspect, the intramolecular bridge is between the side chains of two amino acids that are separated by three intervening amino acids, i.e., between the side chains of amino acids i and i+4. In some embodiments, the intramolecular bridge is a lactam bridge. In a more specific embodiment of the invention, the Class 3 glucagon related analog peptide comprises a large, aromatic amino acid at position 1 and a lactam bridge between the amino acids at positions 16 and 20 of the peptide. Such a Class 3 glucagon related analog peptide may further comprise one or more (e.g., two, three, four, five or more) of the other modifications described herein. For example, the Class 3 glucagon related analog peptide can comprise an amide in place of the C-terminal carboxylate. Accordingly, in one embodiment, the Class 3 glucagon related analog peptide comprises that amino acid sequence of SEQ ID NO: 555.

In accordance with yet another embodiment of the invention, the Class 3 glucagon related analog peptide has enhanced GLP-1 activity and comprises (a) one or more substitutions within amino acid positions 12-29 with an α,α-disubstituted amino acid and optionally, (b) a C-terminal amide. In some aspects, it is to be appreciated that such Class 3 glucagon related analog peptides specifically lack an intramolecular bridge that stabilizes the alpha-helix in the C-terminal portion of glucagon (around positions 12-29). In some embodiments, one, two, three, four or more of positions 16, 17, 18, 19, 20, 21, 24 or 29 of the Class 3 glucagon related analog peptide is substituted with an α,α-disubstituted amino acid, e.g., amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). For example, substitution of position 16 with AIB enhances GLP-1 activity, in the absence of a salt bridge or lactam. In some embodiments, one, two, three or more of positions 16, 20, 21 or 24 are substituted with AIB. Such a Class 3 glucagon related analog peptide may further comprise one or more of the other modifications described herein, including, but not limited to, acylation, alkylation, pegylation, deletion of 1-2 amino acids at the C-terminus, addition of and/or substitution with charged amino acids at the C-terminus, replacement of the C-terminal carboxylate with an amide, addition of a C-terminal extension, and conservative and/or non-conservative amino acid substitutions, such as substitution of Met at position 27 with Leu or Nle, substitution of Asp at position 15 with Glu (or like amino acid), substitution at position 1 and/or 2 with amino acids which achieve DPP-IV protease resistance, substitution of Ser at position 2 with Ala, substitution of Tyr at position 10 with Val or Phe, substitution of Lys at position 12 with Arg, substitution of Ser at position 16 with Thr or AIB, substitution of Gln at position 20 and/or 24 with Asp, Glu, or AIB, substitution of Ser at position 16 with Glu or Thr, Arg at position 18 with Ala, Gln at position 20 with Lys, Asp at position 21 with Glu, and Gln at position 24 with Asn or Cys. In some embodiments, the foregoing Class 3 glucagon related analog peptide comprises a Gln or Gly at position 29 or addition of a C-terminal extension, e.g., GGPSSGAPPPS (SEQ ID NO: 26)C-terminal to the amino acid at position 28. In a specific aspect, the Class 3 glucagon related analog peptide comprises one or more of an amide group in place of the C-terminal carboxylate, an acyl group, e.g., a C16 fatty acid, and a hydrophilic moiety, e.g., a polyethylene glycol (PEG). Also, in another specific aspect, the Class 3 glucagon related analog peptide comprises the amino acid sequence of any of SEQ ID NOs: 1-25, 30-64, and 66-555 comprising no more than ten modifications relative to SEQ ID NO: 1 and comprising one or more amino acid substitutions with AIB at positions 16, 20, 21, and/or 24, wherein the peptide lacks an intramolecular bridge between the side chains of two amino acids of the peptide. Accordingly, in a more specific aspect, the Class 3 glucagon related analog peptide comprises the amino acid sequence of any of SEQ ID NOs: 556-561.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 17, 18, 19, 20, 21, 24, 27, 28 or 29 of the Class 3 glucagon related analog peptide of SEQ ID NO: 11 can be substituted with an amino acid different from that present in the native glucagon peptide, and still retain activity at the glucagon receptor. In one embodiment the methionine residue present at position 27 of the native peptide is changed to leucine or norleucine to prevent oxidative degradation of the peptide. In another embodiment the amino acid at position 20 is substituted with Lys, Arg, Orn or Citrullene and/or position 21 is substituted with Glu, homoglutamic acid or homocysteic acid.

In one embodiment, the Class 3 glucagon related analog peptide comprises SEQ ID NO: 20 with an additional 1 to 6 amino acid changes, selected from positions 1, 2, 5, 7, 10, 11, 13, 14, 17, 18, 19, 21, 27, 28 or 29, differing from the corresponding amino acid of SEQ ID NO: 1, with the proviso that when the amino acid at position 16 is serine, position 20 is Lys, or alternatively when position 16 is serine the position 24 is Glu and either position 20 or position 28 is Lys. In accordance with another embodiment, the Class 3 glucagon related analog peptide comprises SEQ ID NO: 20 with 1 to 3 amino acids selected from positions 1, 2, 5, 7, 10, 11, 13, 14, 17, 18, 19, 20, 21, 27, 28 or 29 differing from the corresponding amino acid of SEQ ID NO: 1. In another embodiment, the Class 3 glucagon related analog peptide comprises SEQ ID NO: 8, SEQ ID NO: 9 or SEQ ID NO: 11 with 1 to 2 amino acids selected from positions 1, 2, 5, 7, 10, 11, 13, 14, 17, 18, 19, 20 or 21 differing from the corresponding amino acid of SEQ ID NO: 1, and in a further embodiment, the one to two differing amino acids represent conservative amino acid substitutions relative to the amino acid present in the native glucagon sequence (SEQ ID NO: 1). In one embodiment, the Class 3 glucagon related analog peptide comprises SEQ ID NO: 12, SEQ ID NO: 13, SEQ ID NO: 14 or SEQ ID NO: 15 further comprising one, two or three amino acid substitutions at positions selected from positions 2, 5, 7, 10, 11, 13, 14, 17, 18, 19, 20, 21, 27 or 29. In one embodiment, the substitutions at positions 2, 5, 7, 10, 11, 13, 14, 16, 17, 18, 19, 20, 21, 27 or 29 are conservative amino acid substitutions.

In accordance with one embodiment, the Class 3 glucagon related analog peptide comprises a variant sequence of SEQ ID NO: 33, wherein 1 to 10 amino acids selected from positions 16, 17, 18, 20, 21, 23, 24, 27, 28 and 29, respectively, differ from the corresponding amino acid of SEQ ID NO: 1. In accordance with one embodiment, the Class 3 glucagon related analog peptide differs from SEQ ID NO: 33 by one or more amino acid substitutions selected from the group consisting of Gln17, Ala18, Glu21, Ile23, Ala24, Val27 and Gly29. In accordance with one embodiment, the Class 3 glucagon related analog peptide comprises variant sequences of SEQ ID NO: 33, wherein 1 to 2 amino acids selected from positions 17-26 differ from the corresponding amino acid of SEQ ID NO: 1. In accordance with one embodiment, the Class 3 glucagon related analog peptide comprises a variant sequence of SEQ ID NO: 33, which differs from SEQ ID NO: 33 by an amino acid substitution selected from the group consisting of Gln17, Ala18, Glu21, Ile23 and Ala24. In accordance with one embodiment, the variant sequence of SEQ ID NO 33 differs from SEQ ID NO: 33 by an amino acid substitution at position 18 wherein the substituted amino acid is selected from the group consisting of Ala, Ser, Thr, and Gly. In accordance with one embodiment, the variant sequence of SEQ ID NO 33 differs from SEQ ID NO: 33 by an amino acid substitution of Ala at position 18. Such variations are encompassed by SEQ ID NO: 55. In another embodiment, the Class 3 glucagon related analog peptide comprises a variant sequence of SEQ ID NO: 33, wherein 1 to 2 amino acids selected from positions 17-22 differ from the corresponding amino acid of SEQ ID NO: 1, and in a further embodiment, the variant sequence of SEQ ID NO: 33 variant differs from SEQ ID NO: 33 by 1 or 2 amino acid substitutions at positions 20 and 21. In accordance with one embodiment, Class 3 glucagon related analog peptide comprises the sequence: NH2-His-Ser-Gln-Gly-Thr-Phe-Thr-Ser-Asp-Tyr-Ser-Lys-Tyr-Leu-Xaa-Xaa-Arg-Arg-Ala-Xaa-Xaa-Phe-Val-Xaa-Trp-Leu-Met-Xaa-Xaa-R (SEQ ID NO: 51), wherein the Xaa at position 15 is Asp, Glu, cysteic acid, homoglutamic acid or homocysteic acid, the Xaa at position 16 is Ser, Glu, Gln, homoglutamic acid or homocysteic acid, the Xaa at position 20 is Gln, Lys, Arg, Orn or citrulline, the Xaa at position 21 is Asp, Glu, homoglutamic acid or homocysteic acid, the Xaa at position 24 is Gln or Glu, the Xaa at position 28 is Asn, Lys or an acidic amino acid, the Xaa at position 29 is Thr or an acid amino acid and R is COOH or CONH$_2$. In one embodiment R is CONH$_2$. In accordance with one embodiment, the Class 3 glucagon related analog peptide comprises a variant sequence of SEQ ID NO: 11, SEQ ID NO: 12, SEQ ID NO: 13, SEQ ID NO: 14, SEQ ID NO: 15, SEQ ID NO: 47, SEQ ID NO: 48 or SEQ ID NO: 49, which differs from said sequence by an amino acid substitution at position 20. In one embodiment the amino acid substitution is selected form the group consisting of Lys, Arg, Orn or citrulline for position 20.

In one embodiment, the Class 3 glucagon related analog peptide comprises an analog peptide sequence of SEQ ID NO: 34 which differs from SEQ ID NO: 34 by having an amino acid other than serine at position 2. In one embodiment, the serine residue is substituted with aminoisobutyric acid, D-alanine, and in one embodiment the serine residue is substituted with aminoisobutyric acid. Such modifications suppresses cleavage by dipeptidyl peptidase IV while retaining the inherent potency of the parent compound (e.g. at least 75, 80, 85, 90, 95% or more of the potency of the parent compound). In one embodiment, the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment, the Class 3 glucagon related analog peptide further comprises an acidic amino acid substituted for the native amino acid at position 28 or 29 or an acidic amino acid added to the carboxy terminus of the peptide of SEQ ID NO: 34.

In one embodiment, the Class 3 glucagon related analog peptides disclosed herein are further modified at position 1 or 2 to reduce susceptibility to cleavage by dipeptidyl peptidase IV. In one embodiment, the Class 3 glucagon related analog peptide comprises a sequence of SEQ ID NO: 9, SEQ ID NO: 11, SEQ ID NO: 12, SEQ ID NO: 13, SEQ ID NO: 14 or SEQ ID NO: 15 which differs from the parent molecule by a substitution at position 2 and exhibits reduced susceptibility (i.e., resistance) to cleavage by dipeptidyl peptidase IV. More particularly, in one embodiment, position 2 of the Class 3 glucagon related analog peptide is substituted with an amino acid selected from the group consisting of D-serine, D-alanine, valine, α-amino isobutyric acid, glycine, N-methyl serine and ϵ-amino butyric acid. In one embodiment, position 2 of the Class 3 glucagon related analog peptide is substituted with an amino acid selected from the group consisting of D-serine, D-alanine, glycine, N-methyl serine and aminoisobutyric acid. In another embodiment, position 2 of the Class 3 glucagon related analog peptide is substituted with an amino acid selected from the group consisting of D-serine, glycine, N-methyl serine and α-amino butyric acid. In one embodiment, the Class 3 glucagon related analog peptide comprises the sequence of SEQ ID NO: 21 or SEQ ID NO: 22.

In one embodiment, the Class 3 glucagon related analog peptide comprises a vanant sequence of SEQ ID NO: 9, SEQ ID NO: 11, SEQ ID NO: 12, SEQ ID NO: 13, SEQ ID NO: 14 or SEQ ID NO: 15 which differs from the parent molecule by a substitution at position and exhibits reduced susceptibility (i.e., resistance) to cleavage by dipeptidyl peptidase IV. More particularly, position 1 of the Class 3 glucagon related analog peptide is substituted with an amino acid selected from the group consisting of D-histidine, alpha, alpha-dimethyl imidazole acetic acid (DMIA), N-methyl histidine, alpha-methyl histidine, imidazole acetic acid, desaminohistidine, hydroxyl-histidine, acetyl-histidine and homo-histidine. In another embodiment, the Class 3 glucagon related analog peptide comprises an analog peptide of SEQ ID NO: 34 wherein the analog differs from SEQ ID NO: 34 by having an amino acid other than histidine at position 1. In one embodiment, the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment, the analog further comprises an acidic amino acid substituted for the native amino acid at position 28 or 29 or an acidic amino acid added to the carboxy terminus of the peptide of SEQ ID NO: 34. In one embodiment, the acidic amino acid is aspartic acid or glutamic acid.

In one embodiment, the Class 3 glucagon related analog peptide comprises a sequence of SEQ ID NO: 20 further comprising an additional carboxy terminal extension of one amino acid or a peptide selected from the group consisting of SEQ ID NO: 26, SEQ ID NO: 27 and SEQ ID NO: 28. In the embodiment, wherein a single amino acid is added to the carboxy terminus of SEQ ID NO: 20, the amino acid is typically selected from one of the 20 common amino acids, and, in one embodiment, the additional carboxy terminus amino acid has an amide group in place of the carboxylic acid of the native amino acid. In one embodiment, the additional amino acid is selected from the group consisting of glutamic acid, aspartic acid and glycine.

In an alternative embodiment, the Class 3 glucagon related analog peptide comprises at least one lactam ring formed between the side chain of a glutamic acid residue and a lysine residue, wherein the glutamic acid residue and a lysine residue are separated by three amino acids. In one embodiment, the carboxy terminal amino acid of the lactam bearing Class 3 glucagon related analog peptide has an amide group in place of the carboxylic acid of the native amino acid. More particularly, in one embodiment, the Class 3 glucagon related analog peptide comprises a modified glucagon peptide selected from the group consisting of:

```
                                              (SEQ ID NO: 66)
NH2-His-Ser-Gln-Gly-Thr-Phe-Thr-Ser-Asp-Tyr-Ser-

Lys-Tyr-Leu-Asp-Glu-Arg-Arg-Ala-Gln-Asp-Phe-Val-

Gln-Trp-Leu-Met-Xaa-Xaa-R (SEQ ID NO: 67)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Gln-Trp-Leu-Met-Xaa-Xaa-R (SEQ ID NO: 68)
NH2-His-Ser-Gln-Gly-Thr-Phe-Thr-Ser-Asp-Tyr-Ser-

Lys-Tyr-Leu-Asp-Ser-Arg-Arg-Ala-Lys-Asp-Phe-Val-

Glu-Trp-Leu-Met-Xaa-Xaa-R (SEQ ID NO: 69)
NH2-His-Ser-Gln-Gly-Thr-Phe-Thr-Ser-Asp-Tyr-Ser-

Lys-Tyr-Leu-Asp-Ser-Arg-Arg-Ala-Gln-Asp-Phe-Val-

Glu-Trp-Leu-Met-Lys-Xaa-R (SEQ ID NO: 16)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Glu-Trp-Leu-Met-Asn-Thr-R (SEQ ID NO: 17)
NH2-His-Ser-Gln-Gly-Thr-Phe-Thr-Ser-Asp-Tyr-Ser-

Lys-Tyr-Leu-Asp-Glu-Arg-Arg-Ala-Gln-Asp-Phe-Val-

Glu-Trp-Leu-Met-Lys-Thr-R (SEQ ID NO: 18)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Glu-Trp-Leu-Met-Lys-Thr-R
``` wherein Xaa at position 28=Asp, or Asn, the Xaa at position 29 is Thr or Gly, R is selected from the group consisting of COOH, CONH$_2$, glutamic acid, aspartic acid, glycine, SEQ ID NO: 26, SEQ ID NO: 27 and SEQ ID NO: 28, and a lactam bridge is formed between Lys at position 12 and Glu at position 16 for SEQ ID NO: 66, between Glu at position 16 and Lys at position 20 for SEQ ID NO: 67, between Lys at position 20 and Glu at position 24 for SEQ ID NO: 68, between Glu at position 24 and Lys at position 28 for SEQ ID NO: 69, between Lys at position 12 and Glu at position 16 and between Lys at position 20 and Glu at position 24 for SEQ ID NO: 16, between Lys at position 12 and Glu at position 16 and between Glu at position 24 and Lys at position 28 for SEQ ID NO: 17 and between Glu at position 16 and Lys at position 20 and between Glu at position 24 and Lys at position 28 for SEQ ID NO: 18. In one embodiment R, is selected from the group consisting of COOH, CONH$_2$, glutamic acid, aspartic acid, glycine, the amino acid at position 28 is Asn, and the amino acid at position 29 is threonine. In one embodiment, R is CONH$_2$, the amino acid at position 28 is Asn and the amino acid at position 29 is threonine. In another embodiment, R is selected from the group consisting of SEQ ID NO: 26, SEQ ID NO: 29 and SEQ ID NO: 65 and the amino acid at position 29 is glycine.

In a further embodiment, the Class 3 glucagon related analog peptide is selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17 and SEQ ID NO: 18, wherein the peptide further comprises an additional carboxy terminal extension of one amino acid or a peptide selected from the group consisting of SEQ ID NO: 26, SEQ ID NO: 27 and SEQ ID NO: 28. In one embodiment, the terminal extension comprises the sequence of SEQ ID NO: 26, SEQ ID NO: 29 or SEQ ID NO: 65 and the Class 3 glucagon related analog peptide comprises the sequence of SEQ ID NO: 55. In one embodiment, the Class 3 glucagon related analog peptide comprises the sequence of SEQ ID NO: 33 wherein the amino acid at position 16 is glutamic acid, the amino acid at position 20 is lysine, the amino acid at position 28 is asparagine and the amino acid sequence of SEQ ID No: 26 or SEQ ID NO: 29 is linked to the carboxy terminus of SEQ ID NO: 33.

In the embodiment, wherein a single amino acid is added to the carboxy terminus of SEQ ID NO: 20, the amino acid is typically selected from one of the 20 common amino acids, and in one embodiment the amino acid has an amide group in place of the carboxylic acid of the native amino acid. In one embodiment, the additional amino acid is selected from the group consisting of glutamic acid and aspartic acid and glycine. In the embodiments, wherein the Class 3 glucagon related analog peptide further comprises a carboxy terminal extension, the carboxy terminal amino acid of the extension, in one embodiment, ends in an amide group or an ester group rather than a carboxylic acid.

In another embodiment, the Class 3 glucagon related analog peptide comprises the sequence: NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-Xaa-CONH$_2$ (SEQ ID NO: 19), wherein the Xaa at position 30 represents any amino acid. In one embodiment, Xaa is selected from one of the 20 common amino acids, and, in one embodiment, the amino acid is glutamic acid, aspartic acid or glycine. The solubility of this peptide can be further improved by covalently linking a PEG chain to the side chain of amino acid at position 17, 21, 24 or 30 of SEQ ID NO: 19. In a further embodiment, the Class 3 glucagon related analog peptide comprises an additional carboxy terminal extension of a peptide selected from the group consisting of SEQ ID NO: 26, SEQ ID NO: 27 and SEQ ID NO: 28. In accordance with one embodiment the glucagon/GLP-1 receptor co-agonist comprises the sequence of SEQ ID NO: 30, SEQ ID NO: 31 and SEQ ID NO: 32.

Additional site specific modifications internal to the glucagon sequence of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19 and SEQ ID NO: 64 can be made to yield a set of Class 3 glucagon related analog peptides that possess variable degrees of GLP-1 agonism. Accordingly, peptides that possess virtually identical in vitro potency at each receptor have been prepared and characterized. Similarly, peptides with tenfold selectively enhanced potency at each of the two receptors have been identified and characterized. As noted above, substitution of the serine residue at position 16 with glutamic acid enhances the potency of native glucagon at both the glucagon and GLP-1 receptors, but maintains approximately a tenfold selectivity for the glucagon receptor. In addition by substituting the native glutamine at position 3 with glutamic acid (SEQ ID NO: 22) generates a glucagon analog that exhibits approximately a tenfold selectivity for the GLP-1 receptor.

The solubility of the Class 3 glucagon related analog peptides can be further enhanced in aqueous solutions at physiological pH, while retaining the high biological activity relative to native glucagon by the introduction of hydrophilic groups at positions 16, 17, 21, and 24 of the peptide, or by the addition of a single modified amino acid (i.e., an amino acid modified to comprise a hydrophilic group) at the carboxy terminus of the Class 3 glucagon related analog peptide. In accordance with one embodiment, the hydrophilic group comprises a polyethylene (PEG) chain. More particularly, in one embodiment, the Class 3 glucagon related analog peptide comprises the sequence of SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17 or SEQ ID NO: 18 wherein a PEG chain is covalently linked to the side chain of an amino acids at position 16, 17, 21, 24, 29 or the C-terminal amino acid of the Class 3 glucagon related analog peptide, with the proviso that, when the peptide comprises SEQ ID NO: 10, SEQ ID NO: 11, SEQ ID NO: 12 or SEQ ID NO: 13, the polyethylene glycol chain is covalently bound to an amino acid residue at position 17, 21 or 24, when the peptide comprises SEQ ID NO: 14 or SEQ ID NO: 15 the polyethylene glycol chain is covalently bound to an amino acid residue at position 16, 17 or 21, and when the peptide comprises SEQ ID NO: 16, SEQ ID NO: 17 or SEQ ID NO: 18, the polyethylene glycol chain is covalently bound to an amino acid residue at position 17 or 21.

In one embodiment, the Class 3 glucagon related analog peptide comprises the sequence of SEQ ID NO: 11, SEQ ID NO: 12 or SEQ ID NO: 13, wherein a PEG chain is covalently linked to the side chain of an amino acids at position 17, 21, 24, or the C-terminal amino acid of the Class 3 glucagon related analog peptide, and the carboxy terminal amino acid of the peptide has an amide group in place of the carboxylic acid group of the native amino acid. In one embodiment, the Class 3 glucagon related analog peptide comprises a sequence selected from the group consisting of SEQ ID NO: 12, SEQ ID NO: 13, SEQ ID NO: 14, SEQ ID NO: 15, SEQ ID NO: 16, SEQ ID NO: 17, SEQ ID NO: 18 and SEQ ID NO: 19, wherein a PEG chain is covalently linked to the side chain of an amino acid at position 17, 21 or 24 of SEQ ID NO: 12, SEQ ID NO: 13 and SEQ ID NO: 19, or at position 16, 17 or 21 of SEQ ID NO: 14 and SEQ ID NO: 15 or at position 17 or 21 of SEQ ID NO: 16, SEQ ID NO: 17 and SEQ ID NO: 18 of the Class 3 glucagon related analog peptide. In another embodiment, the Class 3 glucagon related analog peptide comprises the sequence of SEQ ID NO: 11 or SEQ ID NO: 19, wherein a PEG chain is covalently linked to the side chain of an amino acids at position 17, 21 or 24 or the C-terminal amino acid of the Class 3 glucagon related analog peptide.

In accordance with one embodiment, and subject to the proviso limitations described in the preceding paragraphs, the Class 3 glucagon related analog peptide is modified to contain one or more amino acid substitution at positions 16, 17, 21, 24, or 29 or the C-terminal amino acid, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. Alternatively, the amino acid having a side chain suitable for crosslinking with hydrophilic moieties, including for example, PEG, can be added to the carboxy terminus of any of the Class 3 glucagon related analog peptides disclosed herein. In accordance with one embodiment, an amino acid substitution is made in the Class 3 glucagon related analog peptide at a position selected from the group consisting of 16, 17, 21, 24, or 29 replacing the native amino acid with an amino acid selected from the group consisting of lysine, cysteine, ornithine, homocysteine and acetyl phenylalanine, wherein the substituting amino acid further comprises a PEG chain covalently bound to the side chain of the amino acid. In one embodiment, the Class 3 glucagon related analog peptide selected form the group consisting of SEQ ID NO: 12, SEQ ID NO: 13, SEQ ID NO: 14, SEQ ID NO: 15, SEQ ID NO: 16, SEQ ID NO: 17, SEQ ID NO: 18, and SEQ ID NO: 19 is further modified to comprise a PEG chain is covalently linked to the side chain of an amino acid at position 17 or 21 of the glucagon peptide. In one embodiment, the pegylated Class 3 glucagon related analog peptide further comprises the sequence of SEQ ID NO: 26, SEQ ID NO: 27 or SEQ ID NO: 29.

In another embodiment, the Class 3 glucagon related analog peptide comprises the sequence of SEQ ID NO: 55 or SEQ ID NO: 56, further comprising a C-terminal extension of SEQ ID NO: 26, SEQ ID NO: 29 or SEQ ID NO: 65 linked to the C-terminal amino acid of SEQ ID NO: 55 or SEQ ID NO: 56, and optionally further comprising a PEG chain covalently linked to the side chain of an amino acids at position 17, 18, 21, 24 or 29 or the C-terminal amino acid of the peptide. In another embodiment, the Class 3 glucagon related analog peptide comprises the sequence of SEQ ID NO: 55 or SEQ ID NO: 56, wherein a PEG chain is covalently linked to the side chain of an amino acids at position 21 or 24 of the Class 3 glucagon related analog peptide and the Class 3 glucagon related analog peptide further comprises a C-terminal extension of SEQ ID NO: 26, or SEQ ID NO: 29.

In another embodiment, the Class 3 glucagon related analog peptide comprises the sequence of SEQ ID NO: 55, or SEQ ID NO: 33 or SEQ ID NO: 34, wherein an additional amino acid is added to the carboxy terminus of SEQ ID NO: 33 or SEQ ID NO: 34, and a PEG chain is covalently linked to the side chain of the added amino acid. In a further embodiment, the pegylated Class 3 glucagon related analog peptide further comprises a C-terminal extension of SEQ ID NO: 26 or SEQ ID NO: 29 linked to the C-terminal amino acid of SEQ ID NO: 33 or SEQ ID NO: 34. In another embodiment, the Class 3 glucagon related analog peptide comprises the sequence of SEQ ID NO: 19, wherein a PEG chain is covalently linked to the side chain of the amino acid at position 30 of the Class 3 glucagon related analog peptide and the Class 3 glucagon related analog peptide further comprises a C-terminal extension of SEQ ID NO: 26 or SEQ ID NO: 29 linked to the C-terminal amino acid of SEQ ID NO: 19.

In accordance with one embodiment, the Class 3 glucagon related analog peptide comprises a sequence of SEQ ID NO: 20, wherein a lactam ring is formed between the side chains of a lysine residue, located at position 12, 20 or 28, and a glutamic acid residue, located at position 16 or 24, wherein the two amino acids of the glucagon peptide whose side chains participate in forming the lactam ring are spaced from one another by three intervening amino acids. In accordance with one embodiment, the lactam bearing Class 3 glucagon related analog peptide comprises an amino acid sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17 and SEQ ID NO: 18. In one embodiment, the carboxy terminal amino acid of the lactam bearing peptide comprises an amide group or an ester group in place of the terminal carboxylic acid. In one embodiment, the Class 3 glucagon related analog peptide comprises SEQ ID NO: 11, SEQ ID NO: 12, SEQ ID NO: 13, and SEQ ID NO: 14, SEQ ID NO: 15, SEQ ID NO: 16, SEQ ID NO: 17 and SEQ ID NO: 18 further comprising an additional amino acid covalently bound to the carboxy terminus of SEQ ID NO: 11, SEQ ID NO: 12, SEQ ID NO: 13, SEQ ID NO: 14, SEQ ID NO: 15, SEQ ID NO: 16, SEQ ID NO: 17 or SEQ ID NO: 18. In a further embodiment, the Class 3 glucagon related analog peptide comprises a sequence selected from the group consisting of SEQ ID NO: 66, SEQ ID NO: 67, SEQ ID NO: 68 and SEQ ID NO: 69 further comprising an additional amino acid covalently bound to the carboxy terminus of SEQ ID NO: 66, SEQ ID NO: 67, SEQ ID NO: 68 and SEQ ID NO: 69. In one embodiment, the amino acid at position 28 is asparagine or lysine and the amino acid at position 29 is threonine.

In accordance with one embodiment, the Class 3 glucagon related analog peptide comprises the amino acid sequence of native glucagon (SEQ ID NO: 1) comprising the following modifications: AIB at position 2, Glu at position 3, Lys at position 10, Glu at position 16, Gln at position 17, Ala at position 18, Lys at position 20, Glu at position 21, Ile at position 23, Ala at position 24; wherein Lys at position 10 is acylated with a C14 or C16 fatty acid, and wherein the C-terminal carboxylate is replaced with an amide. In a specific embodiment, this Class 3 glucagon related analog peptide is attached via its N-terminal amino acid to the dipeptide D-Lys-Sarcosine.

In accordance with some embodiments, the Class 3 glucagon related analog peptide comprises, consists essentially of, or consists of an amino acid sequence of any of SEQ ID NOs: 70-514, 517-534, or 554, optionally with up to 1, 2, 3, 4, or 5 further modifications that retain GLP-1 agonist and/or glucagon agonist activity.

Class 4 Glucagon Related Analog Peptides

In certain embodiments, a glucagon related analog peptide is a Class 4 glucagon related analog peptide (see, e.g., International (PCT) Patent Application No. PCT/US2008/080973, incorporated herein by reference in its entirety).

Activity

In accordance with one embodiment, Class 4 glucagon related analog peptides are provided (hereafter referred to as "Class 4 peptides"). In certain aspects a Class 4 peptide is provided which has glucagon antagonist activity. A glucagon antagonists would be used in any setting where the suppression of glucagon agonism is desired. The most immediate and obvious use would be in the treatment of diabetes where glucagon antagonism has been demonstrated in pre-clinical models of hyperglycemia to yield a lowering of blood glucose. Glucagon antagonists can be further modified to improve the biophysical stability and/or aqueous solubility of the compounds while maintaining the antagonist activity of the parent compound. In certain aspects a Class 4 peptide is defined as a pure glucagon antagonist.

The term "glucagon antagonist" refers to a compound that counteracts glucagon activity or prevents glucagon function. For example, a glucagon antagonist exhibits at least 60% inhibition (e.g., at least 70% inhibition) and preferably, at least 80% inhibition, of the maximum response achieved by glucagon at the glucagon receptor. In one embodiment, the glucagon antagonist exhibits at least 90% inhibition of the maximum response achieved by glucagon at the glucagon receptor. In a specific embodiment, the glucagon antagonist exhibits 100% inhibition of the maximum response achieved by glucagon at the glucagon receptor. Additionally, a glucagon antagonist at a concentration of about 1 µM exhibits less than about 20% of the maximum agonist activity achieved by glucagon at the glucagon receptor. In one embodiment, the glucagon antagonist exhibits less than about 10% of the maximum agonist activity achieved by glucagon at the glucagon receptor. In a specific embodiment, the glucagon antagonist exhibits less than about 5% of the maximum agonist activity achieved by glucagon at the glucagon receptor. In yet another specific embodiment, the glucagon antagonist exhibits 0% of the maximum agonist activity achieved by glucagon at the glucagon receptor.

A "pure glucagon antagonist" is a glucagon antagonist that does not produce any detected stimulation of glucagon or GLP-1 receptor activity, as measured by cAMP production using a validated in vitro model assay (see, e.g., PCT/US2008/080973). For example, a pure glucagon antagonist exhibits less than about 5% (e.g., less than about 4%, less than about 3%, less than about 2%, less than about 1%, about 0%) of the maximum agonist activity achieved by glucagon at the glucagon receptor and exhibits less than about 5% (e.g., less than about 4%, less than about 3%, less than about 2%, less than about 1%, and about 0%) of the maximum agonist activity achieved by GLP-1 at the GLP-1 receptor.

Accordingly, in some aspects, there is provided Class 4 peptides that exhibit pure glucagon antagonist activity. In accordance with one embodiment the glucagon antagonist exhibits activity that reduces glucagon receptor glucagon-induced cAMP production by a maximum of at least 50% when the glucagon receptor is contacted simultaneously with 0.8 nM of glucagon and the glucagon antagonist, as measured by cAMP production in an in vitro assay. In one embodiment, the glucagon antagonist reduces glucagon receptor glucagon-induced cAMP production by a maximum amount of at least 80%.

Class 4 peptides are believed to be suitable for any use that has previously been described for glucagon antagonists. Accordingly, the Class 4 peptides described herein can be used to treat hyperglycemia, or treat other metabolic diseases that result from high blood levels of glucagon or high blood glucose levels. In accordance with one embodiment the patient to be treated using the Class 4 peptides disclosed herein is a domesticated animal, and in another embodiment the patient to be treated is a human. Studies suggest that lack of glucagon suppression in diabetic patients contributes to postprandial hyperglycemia in part via accelerated glycogenolysis. Analysis of blood glucose during an Oral Glucose Tolerance Test (OGTT), and in the presence or absence of somatostatin-induced glucagon suppression, has shown a significant increase in glucose in subjects with higher glucagon levels. Accordingly, the Class 4 peptides of the present invention can be used to treat hyperglycemia, and are expected to be useful for treating a variety of types of diabetes including diabetes mellitus type I, diabetes mellitus type II, or gestational diabetes, either insulin-dependent or non-insulin-dependent, and reducing complications of diabetes including nephropathy, retinopathy and vascular disease.

In one embodiment the terminal ten amino acids of Exendin-4 (i.e. the sequence of SEQ ID NO: 919 (GPSSGAPPPS)) are linked to the carboxy terminus of a Class 4 peptide. These fusion proteins are anticipated to have pharmacological activity for suppressing appetite and inducing weight loss/weight maintenance. In accordance with one embodiment the Class 4 peptides disclosed herein can be further modified to include the amino acid sequence of SEQ ID NO: 919 (GPSSGAPPPS) linked to amino acid 24 of the Class 4 peptide of SEQ ID NO: 942 and administered to individuals to induce weight loss or assist in weight maintenance. More particularly, the Class 4 peptide comprises a sequence selected from the group consisting of SEQ ID NO: 902, SEQ ID NO: 903, SEQ ID NO: 904 SEQ ID NO: 905, SEQ ID NO: 906, SEQ ID NO: 907, SEQ ID NO: 908, SEQ ID NO: 936, SEQ ID NO: 939, SEQ ID NO: 940, SEQ ID NO: 941, SEQ ID NO: 942, SEQ ID NO: 943 and SEQ ID NO: 944 and further comprising the amino acid sequence of SEQ ID NO: 919 (GPSSGAPPPS) linked to amino acid 24 of the Class 4 peptide is used to suppress appetite and inducing weight loss/weight maintenance. In one embodiment the administered Class 4 peptide comprises the sequence of SEQ ID NO: 946 or SEQ ID NO: 947.

Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

The Class 4 peptides of the invention may be administered alone or in combination with other anti-diabetic or anti-obesity agents. Anti-diabetic agents known in the art or under investigation include insulin, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARy inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; or FBPase (fructose 1,6-bisphosphatase) inhibitors.

Anti-obesity agents known in the art or under investigation include appetite suppressants, including phenethylamine type stimulants, phentermine (optionally with fenfluramine or dexfenfluramine), diethylpropion (Tenuate®), phendimetrazine (Prelu-2®, Bontri®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to xenical (Orlistat) or Cetilistat (also known as ATL-962), or GT 389-255.

The Class 4 peptides of the present invention can also be administered to patients suffering from catabolic wasting. It is estimated that over half of cancer patients experience catabolic wasting which is characterized by unintended and progressive weight loss, weakness, and low body fat and muscle. The syndrome is equally common in AIDS patients and can also be present in bacterial and parasitic diseases, rheumatoid arthritis, and chronic diseases of the bowel, liver, lungs, and heart. It is usually associated with anorexia and can manifest as a condition in aging or as a result of physical trauma. Catabolic wasting is a symptom that diminishes the quality of life, worsens the underlying condition, and is a major cause of death. Applicants anticipate that the Class 4 peptides disclosed herein can be administered to patients to treat catabolic wasting.

Pharmaceutical compositions comprising the Class 4 peptides disclosed herein can be formulated and administered to patients to using standard pharmaceutically acceptable carriers and routes of administration known to those skilled in the art. Accordingly the present disclosure also encompasses pharmaceutical compositions comprising one or more of the Class 4 peptides disclosed herein in combination with a pharmaceutically acceptable carrier. The pharmaceutical compositions may comprise the Class 4 peptides as the sole pharmaceutically active component, or the Class 4 peptides can be combined with one or more additional active agents. In accordance with one embodiment a composition is provided comprising a Class 4 peptide of the present invention and a compound that activates the GLP-1 receptor (such as GLP-1, a GLP-1 analog, an exendin-4 analog, or derivatives thereof). In accordance with one embodiment a composition is provided comprising a Class 4 peptide of the present invention and insulin or an insulin analog. Alternatively, a composition provided for inducing weight loss or preventing weight gain can be provided that comprises the sequence of SEQ ID NO: 942 further comprising the amino acid sequence of SEQ ID NO: 919 (GPSSGAPPPS) linked to amino acid 24 of SEQ ID NO: 942, and an anti-obesity peptide. Suitable anti-obesity peptides include those disclosed in U.S. Pat. Nos. 5,691,309, 6,436,435 or US Patent application 20050176643, and including, but not limited to GLP-1, GIP (Gastric Inhibitory Polypeptide), MP1, PYY, MC-4, Leptin.

Class 4 Peptide Structure

In one embodiment Class 4 glucagon related analog peptides are provided wherein the normally occurring aspartic acid at position nine (of glucagon, SEQ ID NO: 901) has been substituted with glutamic acid or a cysteic acid-based derivative. More particularly, deletion of the first amino acid (des-His) and substitution of the aspartic acid at position 9 with glutamic acid, in some aspects, produces a Class 4 peptide. Class 4 glucagon related analog peptides having sulfonic acid substituents substituted at amino acid position nine of glucagon perform similarly to the carboxylic acid-based amino acids but with a few critical differences in relation to physical properties such as solubility. Homocysteic acid (hCysSO$_3$) when substituted for the isosteric glutamic acid at position nine in the conventional des-His, Glu9 Class 4 peptide retains a partial antagonist and weak agonist.

In one embodiment there is provided a Class 4 peptide wherein the first two to five amino acids are removed, and position 9 (according to the numbering of SEQ ID NO: 901) is replaced with hCys(SO$_3$), homoglutamic acid, β-homoglutamic acid, or an alkylcarboxylate derivative of cysteine having the structure of:

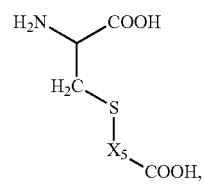

wherein $X_5$ is $C_1$-$C_4$ alkyl, $C_2$-$C_4$ alkenyl, or $C_2$-$C_4$ alkynyl, provides a compound that performs as a hormonal antagonist that is highly specific, potent and without contaminating agonist properties.

In accordance with one embodiment a Class 4 peptide is provided that comprises a glucagon peptide modified, relative to the wild type sequence of SEQ ID NO: 901, by the deletion of two to five amino acid residues from the N-terminus and substitution of the aspartic acid residue at position nine of the native protein with a glutamic acid, homoglutamic acid, β-homoglutamic acid, a sulfonic acid derivative of cysteine, or an alkylcarboxylate derivative of cysteine having the structure of:

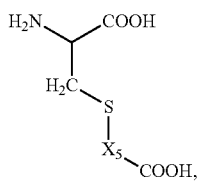

wherein $X_5$ is $C_1$-$C_4$ alkyl, $C_2$-$C_4$ alkenyl, or $C_2$-$C_4$ alkynyl.

In one specific embodiment, the Class 4 peptide comprising the deletion of two to five amino acid residues from the N-terminus and substitution of the Asp at position 9 of the native glucagon, is further modified by up to three amino acid modifications. For example, the Class 4 peptide may comprise one, two, or three conservative amino acid modifications. Alternatively or additionally, the Class 4 peptide may comprise one or more amino acid modifications selected from the group consisting of:

A. substitution of one or two amino acids at positions 10, 20, and 24, (according to the amino acid numbering of SEQ ID NO: 901), or the N- or C-terminal amino acid of the Class 4 peptide with an amino acid covalently attached to an acyl group or alkyl group via an ester, ether, thioether, amide, or alkyl amine linkage;

B. substitution of one or two amino acids at positions 16, 17, 20, 21, and 24 (according to the amino acid numbering of SEQ ID NO: 901), or the N- or C-terminal amino acid of the Class 4 peptide with an amino acid selected from the group consisting of: Cys, Lys, ornithine, homocysteine, and acetyl-phenylalanine (Ac-Phe), wherein the amino acid of the group is covalently bonded to a hydrophilic moiety;

C. addition of an amino acid covalently bonded to a hydrophilic moiety to the N- or C-terminus of the Class 4 peptide;

D. substitution of Asp at position 15 (according to the numbering of SEQ ID NO: 901) with cysteic acid, glutamic acid, homoglutamic acid, and homocysteic acid;

E. substitution of Ser at position 16 (according to the numbering of SEQ ID NO: 901) with cysteic acid, glutamic acid, homoglutamic acid, and homocysteic acid;

F. substitution with AIB at one or more of positions 16, 20, 21, and 24 according to the amino acid numbering of SEQ ID NO: 901;

G. deletion of the amino acid at position 29 or the amino acids at positions 28 and 29, according to the numbering of SEQ ID NO: 901;

H. substitution of each or both of the Asn at position 28 and the Thr at position 29 (according to the amino acid numbering of SEQ ID NO: 901) with charged amino acids; and/or addition of one to two charged amino acids at the C-terminus of SEQ ID NO: 901;

I. substitution of the Met at position 27 (according to the numbering of SEQ ID NO: 901) with Leu or norleucine;

J. addition of a peptide having the amino acid sequence of any of SEQ ID NOs: 919-921 and 953 to the C-terminus of SEQ ID NO: 901; wherein Thr at position 29 (according to the numbering of SEQ ID NO: 901) is Thr or Gly; and K. replacement of the C-terminal carboxylate with an amide or ester.

In a specific embodiment, the Class 4 peptide comprises an amino acid modification of A, B, or C, as described above, or a combination thereof. In yet another specific embodiment, the Class 4 peptide further comprises an amino acid modification of any of D to K as described above, or a combination thereof, in addition to the amino acid modification(s) of A, B, and/or C.

In one embodiment the Class 4 peptide comprises a glucagon peptide, wherein the first 5 amino acids have been removed from the N-terminus, and the remaining N-terminal amino group has been replaced with a hydroxyl group (the "PLA6 analog"), producing the peptide of SEQ ID NO: 939. Applicants have found that substitution of phenyl-lactic acid for phenylalanine in Class 4 peptide analogs that have the first five amino acids deleted and substitution of a glutamic acid at position 9 (relative to native glucagon) further enhances the potency of those Class 4 peptide analogs.

In one embodiment the Class 4 peptide of SEQ ID NO: 939 is further modified by substituting the aspartic acid residue at position four (position 9 of the native glucagon) with an amino acid of the general structure:

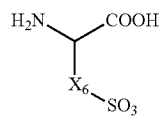

wherein $X_6$ is $C_1$-$C_3$ alkyl, $C_2$-$C_3$ alkene or $C_2$-$C_3$ alkynyl, and in one embodiment $X_6$ is $C_1$-$C_3$ alkyl, and in another embodiment $X_6$ is $C_2$ alkyl. In one embodiment the Class 4 peptide comprises a glucagon peptide, wherein the first 5 amino acids have been removed from the N-terminus, and the aspartic acid residue at position four (position 9 of the native glucagon) has been substituted with cysteic acid or homocysteic acid. In one embodiment the Class 4 peptide comprises a glucagon peptide comprising an amino acid sequence selected from the group consisting of SEQ ID NO: 939, SEQ ID NO: 907 and SEQ ID NO: 908. In one embodiment the Class 4 peptide comprises an amino acid sequence selected from the group consisting of SEQ ID NO: 908, wherein the amino acid at position four is homocysteic acid.

In another embodiment, the Class 4 peptide of SEQ ID NO: 939 is further modified by substituting the aspartic acid residue at position four (position 9 of the native glucagon) with glutamic acid, homoglutamic acid, β-homoglutamic acid, or an alkylcarboxylate derivative of cysteine having the structure of:

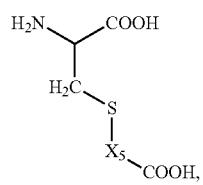

wherein $X_5$ is $C_1$-$C_4$ alkyl, $C_2$-$C_4$ alkenyl, or $C_2$-$C_4$ alkynyl. In a specific embodiment, $X_5$ is $C_1$ or $C_2$ alkyl.

However, applicants have discovered that with the substitution of the N-terminal phenylalanine with PLA in a des1-5 glucagon analog (i.e., a glucagon analog having the first five amino acids deleted), further substitution of the native aspartic acid residue at position four (position 9 of the native glucagon) is not required to produce an analog that exhibits pure antagonism. This result is surprising in light of the prior art teachings that the native aspartic acid residue at position four must substituted to produce high affinity and potent antagonists of glucagon (2-29) analogs. The use of the PLA substitution improves the relative potency of the Asp9 analog to a point comparable to that of the Glu9 and hCys($SO_3$H)9 analogs.

Substitution of the phenylalanine residue with other phenylalanine analogs, including 3,4-2F-phenylalnine (3,4-2F-Phe), 2-naphthyalanine (2-Nal), N-acyl-phenylalanine (Ac-Phe), alpha-methylhydrocinnamic acid (MCA) and benzylmalonic acid (BMA) did not perform as potently as the PLA substitution.

Substituting PLA at sites other than at position six (according to the amino acid numbering of native glucagon), including at positions 4 and 5 reveals that the PLA6 analog is an appreciably more potent antagonist than glucagon analogs having a slightly extended N-terminus. The present invention also includes analogs wherein the N-terminal amino group is substituted with an acylated and alkylated "O-terminal" peptides.

Furthermore, the PLA6 substitution not only increases the potency of the antagonist but also serves a critical role in pegylation. The PLA6 analogs can be selectively pegylated without restoration of glucagon agonism. In the absence of the PLA substitution, pegylation of the analog surprisingly induces glucagon agonism. This glucagon agonism is not seen in the pegylated PLA6 analogs. Several sites for pegylation were investigated including positions 3, 6 and 19 (positions 8, 11 and 19 of native glucagon) and at the N-terminal amino acid residue. In one embodiment the pegylation is at position 19 (position 24 of native glucagon) as that site exhibits the most potent and selective glucagon antagonism.

In one embodiment, the Class 4 peptide comprises the general structure of A-B-C, wherein A is selected from the group consisting of:
  (i) phenyl lactic acid (PLA);
  (ii) an oxy derivative of PLA;
  (iii) a peptide of 2 to 6 amino acids in which two consecutive amino acids of the peptide are linked via an ester or ether bond;

B represents amino acids i to 26 of SEQ ID NO: 901, wherein i is 3, 4, 5, 6, or 7, optionally comprising one or more amino acid modifications selected from the group consisting of:
  (iv) Asp at position 9 (according to the amino acid numbering of SEQ ID NO: 901) is substituted with a Glu, a sulfonic acid derivative of Cys, homoglutamic acid, β-homoglutamic acid, or an alkylcarboxylate derivative of cysteine having the structure of:

$$\text{H}_2\text{N}-\overset{\text{COOH}}{\underset{\text{H}_2\text{C}-\text{S}-X_5-\text{COOH},}{|}}$$

wherein $X_5$ is $C_1$-$C_4$ alkyl, $C_2$-$C_4$ alkenyl, or $C_2$-$C_4$ alkynyl.
  (v) substitution of one or two amino acids at positions 10, 20, and 24, (according to the amino acid numbering of SEQ ID NO: 901) with an amino acid covalently attached to an acyl or alkyl group via an ester, ether, thioether, amide, or alkyl amine linkage;
  (vi) substitution of one or two amino acids at positions 16, 17, 20, 21, and 24 (according to the amino acid numbering of SEQ ID NO: 901) with an amino acid selected from the group consisting of: Cys, Lys, ornithine, homocysteine, and acetyl-phenylalanine (Ac-Phe), wherein the amino acid of the group is covalently attached to a hydrophilic moiety;
  (vii) Asp at position 15 (according to the numbering of SEQ ID NO: 901) is substituted with cysteic acid, glutamic acid, homoglutamic acid, and homocysteic acid;
  (viii) Ser at position 16 (according to the numbering of SEQ ID NO: 901) is substituted with cysteic acid, glutamic acid, homoglutamic acid, and homocysteic acid;
  (ix) substitution with AIB at one or more of positions 16, 20, 21, and 24 according to the amino acid numbering of SEQ ID NO: 901;

and C is selected from the group consisting of:
  (x) X;
  (xi) X—Y;
  (xii) X—Y—Z; and
  (xiii) X—Y—Z—R10, wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 919-921 and 953; and
  (xiv) any of (x) to (xiii) in which the C-terminal carboxylate is replaced with an amide.

In a specific aspect, the Class 4 peptide comprises an oxy derivative of PLA. As used herein "oxy derivative of PLA" refers to a compound comprising a modified structure of PLA in which the hydroxyl group has been replaced with O—$R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula XI:

Formula XI

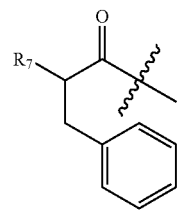

wherein R7 is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art. For example, the hydroxyl group of PLA may be reacted with a halogenated alkyl or tosylated alkyl alcohol to form an ether bond.

Generally, the chemical moiety of $R_{11}$ is one which does not decrease the activity of the Class 4 peptide. In some embodiments, the chemical moiety enhances the activity, stability, and/or solubility of the Class 4 peptide.

In a specific embodiment, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In a specific embodiment, the chemical moiety is an amino acid, which, optionally, is a part of a peptide, such that Formula XI is a depsipeptide. In this regard, PLA may be at a position other than the N-terminal amino acid residue of the Class 4 peptide, such that the Class 4 peptide comprises one or more (e.g., 1, 2, 3, 4, 5, 6, or more) amino acids N-terminal to the PLA residue. For example, the Class 4 peptide can comprise PLA at position n, wherein n is 2, 3, 4, 5, or 6 of the Class 4 peptide.

The amino acids N-terminal to the PLA residue may be synthetic or naturally-occurring. In a specific embodiment, the amino acids which are N-terminal PLA are naturally-occurring amino acids. In one embodiment, the amino acids which are N-terminal to PLA are the N-terminal amino acids of native glucagon. For example, the Class 4 peptide can comprise at the N-terminus the amino acid sequence of any of SEQ ID NOs: 954-958, wherein PLA is linked to threonine via an ester bond:

```
                            SEQ ID NO: 954
His-Ser-Gln-Gly-Thr-PLA

SEQ ID NO: 955
Ser-Gln-Gly-Thr-PLA

SEQ ID NO: 956
Gln-Gly-Thr-PLA

SEQ ID NO: 957
Gly-Thr-PLA

SEQ ID NO: 958
Thr-PLA
```

In an alternative embodiment, one or more of the N-terminal amino acids may be substituted with an amino acid other than the amino acid of native glucagon. For example, when the Class 4 peptide comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the Class 4 peptide is an amino acid selected from the group consisting of D-histidine, alpha, alpha-dimethyl imidazole acetic acid (DMIA), N-methyl histidine, alpha-methyl histidine, imidazole acetic acid, desa-minohistidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobu-tyric acid (AIB). Also, for example, when the Class 4 peptide comprises PLA as the amino acid at position 4, 5, or 6, the amino acid at position 3 of the Class 4 peptide may be glutamic acid, as opposed to the native glutamine residue of native glucagon. In an exemplary embodiment of the invention, the Class 4 peptide comprises at the N-terminus the amino acid sequence of any of SEQ ID NOs: 959-961.

With respect to the Class 4 peptides comprising a compound of Formula XI, the polymer may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, poly-alkylene oxides, polyalkylene terepthalates, polymers of acrylic and methacrylic esters, including poly(methyl methacrylate), poly(ethyl methacrylate), poly(butylmethacrylate), poly(isobutyl methacrylate), poly(hexylmethacrylate), poly (isodecyl methacrylate), poly(lauryl methacrylate), poly (phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysi-loxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly (lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prola-mines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhy-aluronic acids, casein, gelatin, glutin, polyanhydrides, polyacrylic acid, alginate, chitosan, poly(methyl methacrylates), poly(ethyl methacrylates), poly(butylmethacrylate), poly (isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In one embodiment, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene copolymer, polyoxyethyleneglycols, polyethylene oxide, and derivatives, salts, and combinations thereof.

In a specific embodiment, the polymer is a polyalkylene glycol, including, for example, polyethylene glycol (PEG).

The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

With respect to the Class 4 peptides comprising a compound of Formula XI, the lipid may be any lipid comprising a carbonyl with an alpha leaving group. The lipid, for example, may be one which is derivatized to comprise the carbonyl. In this regard, the lipid, may be a derivative of a fatty acid (e.g., a C4-C30 fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide. oil, wax, cholesterol, sterol, fat-soluble vitamin, monoglyceride, diglyceride, triglyceride, a phospholipid.

In one embodiment, R7 has a molecular weight of about 100 kDa or less, e.g., about 90 kDa or less, about 80 kDa or less, about 70 kDa or less, about 60 kDa or less, about 50 kDa or less, about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In an alternative embodiment, the Class 4 peptide comprises as A, a peptide of 2 to 6 amino acids in which two consecutive amino acids of the peptide are linked via an ester or ether bond. The ester or ether bond may be, e.g., between amino acids 2 and 3, 3 and 4, 4 and 5, or 5 and 6. Optionally the peptide may be further modified by covalent linkage to another chemical moiety including linkage to a polymer (e.g. a hydrophilic polymer), alkylation, or acylation.

With regard to the Class 4 peptide comprising the general structure A-B-C, B represents amino acids of native glucagon, e.g., i to 26 of SEQ ID NO: 901, wherein i is 3, 4, 5, 6, or 7, optionally comprising one or more amino acid modifications. In a specific embodiment, B represents amino acids 7 to 26 of SEQ ID NO: 901, optionally further modified.

In one embodiment, B is modified by up to three amino acid modifications. For example, B, which represents native amino acid sequence of SEQ ID NO: 901 is modified by one or more conservative amino acid modifications.

In another embodiment, B comprises one or more amino acid modifications selected from the group consisting of (iv) to (ix), as described herein. In a specific embodiment, B comprises one or both of the amino acid modifications (v) and (vi). In a further specific embodiment, B comprises one or a combination of amino acid modifications selected from the group consisting of (iv), (vii), (viii), and (ix), in addition to (v) and (vi).

In another specific embodiment, the Class 4 peptide comprises one or more charged amino acids at the C-terminus. For example, Y and/or Z can be a charged amino acid, e.g., Lys, Arg, His, Asp, and Glu. In yet another embodiment, the Class 4 peptide comprises one to two charged amino acids (e.g., Lys, Arg, His, Asp, and Glu)C-terminal to Z. In a specific aspect, Z followed by one to two charged amino acids does not comprise R10.

The Class 4 peptide in one embodiment comprises a hydrophilic moiety covalently bound to an amino acid residue of the Class 4 peptide, as described herein. For example, the Class 4 peptide can comprise a hydrophilic moiety covalently attached to an amino acid at position 1, 16, 20, 21, or 24 according to the numbering of SEQ ID NO: 901. In another embodiment, the hydrophilic moiety is attached to the C-terminal amino acid of the Class 4 peptide, which in some cases, is 1 or 11 amino acids C-terminal to Z. In yet another embodiment, the hydrophilic moiety is attached to PLA, when A is PLA, PLA-Phe, or PLA-Thr-Phe, wherein PLA is modified to comprise the hydrophilic moiety. In another embodiment, an amino acid comprising a hydrophilic moiety is added to the N- or C-terminus of the Class 4 peptide. In another embodiment, the Class 4 peptide comprises an acyl group or alkyl group as described herein. For example, the acylation or alkylation can occur off the side chain of the amino acid at position 10, 20, or 24, according to the numbering of SEQ ID NO: 901. In an alternative embodiment, the acylation or alkylation occurs off the side chain of the C-terminal amino acid of the Class 4 peptide, which in some cases, is 1 or 11 amino acids C-terminal to Z. In yet another embodiment, when A is PLA, PLA-Phe, or PLA-Thr-Phe, the PLA is modified to comprise an acyl or alkyl group.

Exemplary Embodiments

The Class 4 peptide may comprise any amino acids, synthetic or naturally occurring, provided that at least two consecutive amino acids of the peptide are linked via an ester or ether bond. In a specific embodiment, the peptide comprises amino acids of native glucagon. For example, the peptide can comprise j to 6 of native glucagon (SEQ ID NO: 901), wherein j is 1, 2, 3, 4, or 5. Alternatively, the peptide can comprise an amino acid sequence based on the N-terminus of SEQ ID NO: 901 with one or more amino acid modifications. The amino acid at position 1 and/or position 2 may be an amino acid which reduces susceptibility to cleavage by dipeptidyl peptidase IV. For instance, the peptide can comprise at position 1 of the Class 4 peptide an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobutyric acid (AIB). Also, for example, the amino acid at position 3 of the Class 4 peptide may be glutamic acid, as opposed to the native glutamine residue of native glucagon. Accordingly, the Class 4 peptide can comprise an amino acid sequence of:

```
                                       (SEQ ID NO: 968)
Xaa1-Xaa2-Xaa3-Thr-Gly-Phe;

(SEQ ID NO: 969)
Xaa2-Xaa3-Thr-Gly-Phe;
or (SEQ ID NO: 970)
Xaa3-Thr-Gly-Phe;
``` wherein $Xaa_1$ is selected from a group consisting of: His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; $Xaa_2$ is selected from a group consisting of: Ser, D-serine, D-alanine, valine, glycine, N-methyl serine, N-methyl alanine, and aminoisobutyric acid (AIB); and $Xaa_3$ is Gln or Glu.

The present invention also encompasses embodiments wherein the C-terminal amino acid of the Class 4 peptides have an amide group substituting for the carboxylic acid group that is present on the native amino acid.

In some embodiments, wherein the Class 4 peptide is PEGylated, the Class 4 peptide comprises the shortened glucagon peptides, specifically 6-29 where the "N-terminal" amino acid is PLA (phenyl-lactic acid). Such glucagon derivatives exhibit unique virtues. They are more potent peptides than those with the native N-terminal phenylalanine and they suppress any glucagon agonism that results from pegylation, something not seen with the native phenylalanine. Finally, while the current literature establishes that a substitution of the native aspartic acid at position 9 is required for antagonist activity, applicants have discovered the surprising result that such a substitution is no longer required in the $PLA^6$-(6-29) glucagon analogs.

In one embodiment an amino acid of the Class 4 peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, an amino acid of the Class 4 peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In accordance with one embodiment the lysine residue corresponding to position 12 of the native peptide is substituted with arginine and a single lysine substitution is inserted for one of the amino acids corresponding to position 1, 16, 17, 20, 21, 24 or 29 of the native peptide, or a lysine is added to the N- or C-terminus of the Class 4 peptide.

In another embodiment the methionine residue corresponding to position 27 of the native peptide is changed to leucine or norleucine to prevent oxidative degradation of the peptide.

In some embodiments, the Class 4 peptides described herein are further modified by truncation or deletion of one or two amino acids of the C-terminus of the glucagon peptide (i.e., truncation of the amino acid at position 29 or at positions 28 and 29 of native glucagon) without affecting activity and/or potency at the glucagon receptor. In this regard, the Class 4 peptide described herein can, for example, consist essentially of or consist of amino acids 1-27, 1-28, 2-27, 2-28, 3-27, 3-28, 4-27, 4-28, 5-27, 5-28, 6-27, or 6-28 of the native glucagon peptide (SEQ ID NO: 901) with one or more modifications resulting in Class 4 peptideic activity as described herein.

The presently disclosed Class 4 peptides also encompass amino acid substitutions at positions that are known not to be critical to the function of the glucagon peptide. In one embodiment the substitutions are conservative amino acid substitutions at one, two or three positions selected from the group consisting of 2, 5, 6, 7, 8, 9, 12, 13, 14, 15, 16, 19, 22, 23 or 24 of SEQ ID NO: 939. In one embodiment the Class 4 peptide comprises a derivative peptide of SEQ ID NO: 942 wherein the glucagon peptide comprises a further amino acid substitution relative to SEQ ID NO: 942 at one to three amino acid positions selected from positions 2, 5, 6, 8, 9, 12, 13 and 14. In one embodiment the substitutions at positions 2, 5, 6, 8, 9, 12, 13 and 14 of SEQ ID NO: 942 are conservative amino acid substitutions. In one embodiment the amino acids corresponding to positions 16, 17, 20, 21, 24 or 29 of the native peptide, and more particularly at position 21 and/or 24 are substituted with cysteine or lysine, wherein a PEG chain is covalently attached to the substituted cysteine or lysine residue.

In accordance with one embodiment the modified Class 4 peptide comprises two or more polyethylene chains covalently bound to the peptide wherein the total molecular weight of the glucagon chains is about 1,000 to about 5,000 Daltons. In one embodiment the pegylated Class 4 peptide comprises a peptide selected from the group consisting of SEQ ID NO: 912, and SEQ ID NO: 922, wherein said peptide comprise a polyethylene glycol chain linked to the amino acid at positions 11 and 19 and the combined molecular weight of the two PEG chains is about 1,000 to about 5,000 Daltons.

In accordance with one embodiment a Class 4 peptide is provided comprising a modified glucagon peptide selected from the group consisting of:

```
                                             (SEQ ID NO: 909)
R1-Phe-Thr-Ser-Xaa-Tyr-Ser-Xaa-Tyr-Leu-Xaa-Xaa-

Arg-Arg-Ala-Gln-Asp-Phe-Val-Gln-Trp-Leu-Xaa-Asn-

Thr-R2, (SEQ ID NO: 910)
R1-Phe-Thr-Ser-Xaa-Tyr-Ser-Xaa-Tyr-Leu-Asp-Ser-

Arg-Arg-Ala-Gln-Xaa-Phe-Val-Gln-Trp-Leu-Xaa-Asn-

Thr-R2,
```

-continued (SEQ ID NO: 911)
R₁-Phe-Thr-Ser-Xaa-Tyr-Ser-Xaa-Tyr-Leu-Asp-Ser-

Arg-Arg-Ala-Gln-Asp-Phe-Val-Xaa-Trp-Leu-Xaa-Asn-

Thr-R₂
and (SEQ ID NO: 912)
R₁-Phe-Thr-Ser-Xaa-Tyr-Ser-Xaa-Tyr-Leu-Asp-Ser-

Arg-Arg-Ala-Gln-Xaa-Phe-Val-Xaa-Trp-Leu-Xaa-Asn-

Thr-R₂, wherein Xaa at position 4=aspartic acid, glutamic acid, cysteic acid or homocysteic acid, Xaa at position 7=Lys or Arg, Xaa at position 10 is aspartic acid, cysteic acid, glutamic acid, homoglutamic acid and homocysteic acid; Xaa at position 11 is Ser, Lys, Cys, Orn, homocysteine or acetyl phenylalanine, Xaa at position 16 is Asp, Lys, Cys, Orn, homocysteine or acetyl phenylalanine and Xaa at position 19 is Gln, Lys, Cys, Orn, homocysteine and acetyl phenylalanine, Xaa at position 22=Met, Leu or Nle, R₁ is OH or NH₂, and R₂ is COOH or CONH₂, wherein the peptide is pegylated at position 11 for SEQ ID NO: 909, at position 16 for SEQ ID NO: 910, position 19 for SEQ ID NO: 911 and at positions 16 and 19 of SEQ ID NO: 912, with the proviso that when Xaa at position 4=aspartic acid then R₁ is OH. In accordance with one embodiment the peptide comprises the sequence of SEQ ID NO: 909, SEQ ID NO: 910 or SEQ ID NO: 911, wherein R₁ is OH and R₂ is CONH₂. In one embodiment the peptide comprises the sequence of SEQ ID NO: 909, SEQ ID NO: 910 or SEQ ID NO: 911, wherein R₁ is OH, R₂ is CONH₂ and the amino acid at position 4 is aspartic acid, and in a further embodiment such peptides comprise a carboxy terminal extension comprising the sequence of SEQ ID NO: 919.

In accordance with one embodiment the peptide comprises a sequence selected from the group consisting of SEQ ID NO: 909, SEQ ID NO: 910, SEQ ID NO: 913, SEQ ID NO: 914, and SEQ ID NO: 916, wherein the peptide is pegylated at position 11 for SEQ ID NO: 909 and SEQ ID NO: 913, pegylated at position 16 for SEQ ID NO: 910, and pegylated at position 19 for SEQ ID NO: 910 and SEQ ID NO: 914. In one embodiment the glucagon agonist comprises the peptide of SEQ ID NO: 913 or SEQ ID NO: 914. In one embodiment the C-terminal amino acid of the Class 4 peptides disclosed herein have an amide group in place of the carboxylic acid group that is present on the native amino acid. In accordance with one embodiment the Class 4 peptide comprises the sequence of SEQ ID NO: 918.

In accordance with one embodiment, a Class 4 peptide is provided wherein a plasma protein has been covalently linked to an amino acid side chain of the peptide to improve the solubility, stability and/or pharmacokinetics of the glucagon peptide. For example, serum albumin can be covalently bound to the Class 4 peptides presented herein. In one embodiment the plasma protein is covalently bound to an amino acid corresponding to position 16, 17, 20, 21, 24 or 29 of the native glucagon peptide. More particularly, in one embodiment the plasma protein is bound to an amino acid corresponding to position 16 or 24 of the native glucagon peptide, wherein the Class 4 peptide comprises the sequence of SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 911, SEQ ID NO: 912, SEQ ID NO: 922, SEQ ID NO: 923, SEQ ID NO: 924, SEQ ID NO: 925, SEQ ID NO: 926, SEQ ID NO: 927, SEQ ID NO: 928, SEQ ID NO: 936 and SEQ ID NO: 939. In one embodiment the Class 4 peptide comprises a peptide selected from the group consisting of SEQ ID NO: 909, SEQ ID NO: 910, SEQ ID NO: 911 and SEQ ID NO: 912.

In accordance with one embodiment, a Class 4 peptide is provided wherein a linear amino acid sequence representing the Fc portion of an immunoglobin molecule has been covalently linked to an amino acid side chain of a Class 4 peptide disclosed herein to improve the solubility, stability and/or pharmacokinetics of the glucagon peptide. For example, the amino acid sequence representing the Fc portion of an immunoglobin molecule can be covalently bound to position 11, 12, 15, 16, 19, 21 or 24 of the glucagon peptide of SEQ ID NO: 907, SEQ ID NO: 939, or a glucagon analog thereof. In one embodiment the Fc peptide is covalently bound to position 11 or 19 of the Class 4 peptide of SEQ ID NO: 906, SEQ ID NO: 907, SEQ ID NO: 908 or SEQ ID NO: 936. The Fc portion is usually isolated from IgG, but the Fc peptide fragment from any immunoglobin should function equivalently. In one embodiment the glucagon peptide is selected from the group consisting of SEQ ID NO: 903, SEQ ID NO: 904, SEQ ID NO: 905, SEQ ID NO: 907 SEQ ID NO: 908, and SEQ ID NO: 939, wherein the Fc portion is linked to the corresponding position of 16, 17, 20, 21, 24 or 29 of the native glucagon peptide. In one embodiment the Class 4 peptide comprises a glucagon peptide selected from the group consisting of SEQ ID NO: 909, SEQ ID NO: 910, SEQ ID NO: 911 and SEQ ID NO: 912, wherein the Fc peptide is bound to the side chain of the amino acid located at position 11, 16 or 19 of SEQ ID NO: 909, SEQ ID NO: 910, SEQ ID NO: 911, respectively, and at both positions 11 and 19 for SEQ ID NO: 912.

In certain embodiments of the invention, the Class 4 peptide comprises the amino acid sequence of any of SEQ ID NOs: 962, 964-967, and 971.

Modifications to Improve Solubility

The Class 4 peptides can be further modified to improve the peptide's solubility in aqueous solutions at physiological pH, while, in some aspects retaining a glucagon antagonist activity. Introduction of hydrophilic groups at positions corresponding to positions 1, 16, 17, 20, 21, 24 and 29 of the native peptide, or at the C-terminus, can improve the solubility of the resulting Class 4 peptide in solutions having a physiological pH, while retaining the parent compounds antagonist activity. Therefore, in one embodiment the presently disclosed Class 4 peptides are further modified to comprise one or more hydrophilic groups covalently linked to the side chains of amino acids corresponding to amino acid positions 1, 16, 17, 20, 21, 24 and 29 of the native glucagon peptide or of the N- or C-terminal amino acid. In a further embodiment the side chains of amino acids corresponding to amino acid positions 16 and 24 of the native glucagon peptide are covalently bound to hydrophilic groups, and in one embodiment the hydrophilic group is polyethylene glycol (PEG).

Applicants have also discovered that native glucagon can be modified by introducing charge at its carboxy terminus to enhance the solubility of the peptide while retaining the agonist properties of the peptide. The enhanced solubility allows for the preparation and storage of glucagon solutions at near neutral pH. Formulating glucagon solutions at relatively neutral pHs (e.g. pH of about 6.0 to about 8.0) improves the long term stability of the Class 4 peptides.

Again, applicants anticipate that the Class 4 peptides disclosed herein can be similarly modified to enhance their solubility in aqueous solutions at relatively neutral pH (e.g. pH of about 6.0 to about 8.0) while retaining the antagonist properties of the parent protein. Accordingly, one embodiment of the present invention is directed to a Class 4 peptide of SEQ ID NO: 939 that has been further modified relative to the native amino acids present at positions 6-29 of the wild type glucagon (SEQ ID NO: 901) to add charge to the peptide by the substitution of native non-charged amino acids with charged amino acids, or the addition of charged amino acids to the carboxy terminus. In accordance with one embodiment, one to three of the non-charged native amino acids of the Class 4 peptide of SEQ ID NO: 939 are replaced with a charged amino acid. In one embodiment the charged amino acid is selected from the group consisting of lysine, arginine, histidine, aspartic acid and glutamic acid. More particularly, applicants have discovered that substituting the normally occurring amino acid at corresponding position 28 and/or 29 relative to native glucagon with charged amino acids, and/or the addition of one to two charged amino acids at the carboxy terminus of the Class 4 peptide, enhances the solubility and stability of the Class 4 peptides in aqueous solutions at physiologically relevant pHs (i.e., a pH of about 6.5 to about 7.5). Accordingly, such modifications of the Class 4 peptide disclosed herein are anticipated to have a similar effect on the solubility in aqueous solutions, particularly at a pH ranging from about 5.5 to about 8.0, while retaining the parent peptide's biological activity In accordance with one embodiment the Class 4 peptide of SEQ ID NO: 939 is modified by the substitution of the native amino acid at corresponding position 28 and/or 29 relative to native glucagon with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the Class 4 peptide of SEQ ID NO: 939 is modified by the substitution of the native amino acid at corresponding position 29 relative to native glucagon with a positively charged amino acid (e.g., lysine, arginine or histidine) and optionally the addition of one or two positively charged amino acid (e.g., lysine, arginine or histidine) on the carboxy terminus of the peptide. In accordance with one embodiment a Class 4 peptide having improved solubility and stability is provided wherein the peptide comprises the amino acid sequence of SEQ ID NO: 941 with the proviso that at least one amino acids at position, 23, or 24 of SEQ ID NO: 941 is substituted with an acidic amino acid, and/or an additional acidic amino acid is added at the carboxy terminus of SEQ ID NO: 941. In one embodiment the acidic amino acids are independently selected from the group consisting of Asp, Glu, cysteic acid and homocysteic acid.

In accordance with one embodiment a Class 4 peptide having improved solubility and stability is provided wherein the antagonist comprises the amino acid sequence of SEQ ID NO: 941, SEQ ID NO: 942, SEQ ID NO: 943 or SEQ ID NO: 944, wherein at least one of the amino acids at positions 23 or 24 is substituted with a non-native amino acid residue (i.e. at least one amino acid present at position 23 or 24 of the analog is an acidic amino acid different from the amino acid present at the corresponding position in SEQ ID NO: 907). In accordance with one embodiment a glucagon agonist is provided comprising the sequence of SEQ ID NO: 941 or 942 with the proviso that when the amino acid at position 23 is asparagine and the amino acid at position 24 is threonine, the peptide further comprises one to two amino acids, independently selected from the group consisting of Lys, Arg, His, Asp or Glu, added to the carboxy terminus of the Class 4 peptide.

In another embodiment the solubility of the Class 4 peptide of SEQ ID NO: 942 can be improved by covalently linking a hydrophilic moiety to an amino acid residue at position 11, 12, 15, 16, 19 or 24, and in one embodiment the hydrophilic moiety is linked to an amino acid at position 11, 16 or 19, and in a further embodiment the hydrophilic moiety is linked to amino acid 19. In one embodiment the hydrophilic moiety is a plasma protein or the Fc portion of an immunoglobin, and in an alternative embodiment the hydrophilic moiety is a hydrophilic hydrocarbon chain. In one embodiment the hydrophilic moiety is polyethylene glycol, having a molecular weight selected from the range of about 1,000 to about 5,000 Daltons. In another embodiment the hydrophilic moiety is polyethylene glycol, having a molecular weight of at least about 20,000 Daltons. In one embodiment the polyethylene modified Class 4 peptide comprises the amino acids sequence of SEQ ID NO: 909, SEQ ID NO: 910, SEQ ID NO: 911, SEQ ID NO: 912, SEQ ID NO: 943, SEQ ID NO: 944 or SEQ ID NO: 945.

Modifications to Improve Stability

The Asp-Ser sequence at position 15-16 of native glucagon has been identified as a uniquely unstable dipeptide that leads to premature chemical cleavage of the native hormone in aqueous buffers. For example, when maintained at 0.01N HCl at 37° C. for 2 weeks, more than 50% of the native glucagon may be cleaved into fragments. The two liberated cleavage peptides 1-15 and 16-29 are devoid of glucagon-like biological activity and thus represent a limitation on the aqueous pre-formulation of glucagon and its related analogs. The selective chemical substitution of the Asp at position 15 of the native glucagon peptide with Glu has been observed to virtually eliminate chemical cleavage of the 15-16 peptide bond.

Accordingly, it is expected that the Class 4 peptides of the present invention can be similarly modified to decrease their susceptibility to premature chemical cleavage in aqueous buffers. In accordance with one embodiment the Class 4 peptides described herein can be further modified to enhance their stability in aqueous solutions by replacing the native aspartic amino acid, located at position 15 of the native glucagon peptide, with an amino acid selected from the group consisting of cysteic acid, glutamic acid, homoglutamic acid and homocysteic acid. In accordance with one embodiment the aspartic acid residue at position 10 of the Class 4 peptide of SEQ ID NO: 939 can be substituted with an amino acid selected from the group consisting of cysteic acid, glutamic acid, homoglutamic acid and homocysteic acid, and in one embodiment the native aspartic acid at position 10 of SEQ ID NO: 939 is replaced with glutamic acid. In accordance with one embodiment a Class 4 peptide having improved stability in aqueous solutions is provided wherein the antagonist comprises a sequence selected from the group consisting of SEQ ID NO: 936, SEQ ID NO: 940 and SEQ ID NO: 942. In a further embodiment the Class 4 peptide is amidated.

In accordance with one embodiment, increased stability by way of reduced degradation of the Class 4 peptide described herein may also be achieved by substitution of the serine at position 16 (according to the numbering of native glucagon) with glutamic acid, cysteic acid, homo-glutamic acid, or homo-cysteic acid. In a specific embodiment, the serine at position 16 (according to the native glucagon sequence numbering) is replaced with glutamic acid. In a more specific aspect, the Class 4 peptide comprising such a modification comprises a C-terminal carboxylate and is not amidated.

In accordance with one embodiment, a Class 4 peptide is provided comprising a glucagon peptide selected from the group consisting of SEQ ID NO: 907, SEQ ID NO: 936, SEQ ID NO: 939, SEQ ID NO: 940, SEQ ID NO: 941, SEQ ID NO: 942, SEQ ID NO: 943 and SEQ ID NO: 944, further modified by one or more additional amino acid substitutions at positions corresponding to positions 11, 12, 15, 16, 19 and/or 24 of the native glucagon peptide, wherein the amino acid substitutions comprise a substitution with an amino acid having a side chain suitable for crosslinking with hydrophilic moieties, including for example, PEG. The peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. In one embodiment a Class 4 peptide is provided wherein the peptide comprises the sequence of SEQ ID NO: 907, SEQ ID NO: 936, SEQ ID NO: 939, SEQ ID NO: 940, SEQ ID NO: 941, SEQ ID NO: 942, SEQ ID NO: 943 and SEQ ID NO: 944, and further comprises a polyethylene chain bound to corresponding position 21 or 24 of the native glucagon peptide. In a further embodiment the C-terminus of the Class 4 peptide is modified to replace the carboxylic acid group with an amide group.

Fusion Peptides and Conjugates

The present disclosure also encompasses Class 4 peptide fusion peptides wherein a second peptide has been fused to the C-terminus of the Class 4 peptide. More particularly, the fusion peptide may comprise a Class 4 peptide of SEQ ID NO: 944 that further comprises an amino acid sequence of SEQ ID NO: 919 (GPSSGAPPPS), SEQ ID NO: 920 (Lys Arg Asn Arg Asn Asn Ile Ala) or SEQ ID NO: 921 (Lys Arg Asn Arg) linked to the c-terminal amino acid of the Class 4 peptide. In one embodiment the amino acid sequence of SEQ ID NO: 919 (GPSSGAPPPS) is bound to amino acid 24 of the Class 4 peptide of SEQ ID NO: 942 through a peptide bond. In another embodiment the fusion peptide comprises a Class 4 peptide of SEQ ID NO: 907, SEQ ID NO: 936, SEQ ID NO: 939, SEQ ID NO: 940, SEQ ID NO: 941 or SEQ ID NO: 943 that further comprises an amino acid sequence of SEQ ID NO: 919 (GPSSGAPPPS) linked to amino acid 24 of the Class 4 peptide. In another embodiment the fusion peptide comprises a Class 4 peptide of SEQ ID NO: 907, SEQ ID NO: 936, SEQ ID NO: 937, SEQ ID NO: 938, SEQ ID NO: 939, SEQ ID NO: 941 or SEQ ID NO: 943 that further comprises an amino acid sequence of SEQ ID NO: 920, SEQ ID NO: 921 or SEQ ID NO: 953 linked to amino acid 24 of the Class 4 peptide. In one embodiment the Class 4 peptide fusion peptide comprises a sequence selected from the group consisting of SEQ ID NO: 946 and SEQ ID NO: 947. In a further embodiment the C-terminus of the fusion peptide is modified to replace the carboxylic acid group with an amide group.

In one embodiment a Class 4 peptide fusion peptide is provided wherein the Class 4 peptide portion of the fusion peptide is selected from the group consisting of SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 911, SEQ ID NO: 912, SEQ ID NO: 913, SEQ ID NO: 914, SEQ ID NO: 915, SEQ ID NO: 910, SEQ ID NO: 916, SEQ ID NO: 917, SEQ ID NO: 918 and SEQ ID NO: 939 and the sequence of SEQ ID NO: 919 is fused to the carboxy terminus of the Class 4 peptide portion, and wherein the PEG chain, when present, is selected from the range of 500 to 40,000 Daltons. More particularly, in one embodiment the Class 4 peptide segment is selected from the group consisting of SEQ ID NO: 913, SEQ ID NO: 914, SEQ ID NO: 915, SEQ ID NO: 916, SEQ ID NO: 946 and SEQ ID NO: 947 wherein the PEG chain is selected from the range of about 500 to about 5,000 Daltons, and more particularly, in one embodiment the PEG chain is about 1,000 Daltons. In a further embodiment the C-terminus is modified to replace the carboxylic acid group with an amide group.

The Class 4 peptide may further comprise one to two charged amino acids added to the carboxy terminus. In one embodiment, wherein one to two charged amino acids are added to the carboxy terminus of SEQ ID NO: 944, the amino acids are negatively charged amino acids, including for example glutamic acid and aspartic acid. In one embodiment, the Class 4 peptide comprises the sequence of SEQ ID NO: 942 wherein at least one of corresponding positions 27 and 28 relative to the native glucagon peptide comprises an amino acid selected from the group consisting of aspartic acid and glutamic acid and wherein SEQ ID NO: 942 is optionally modified to include an addition one to two negatively charged amino acids added to the carboxy terminus. In one embodiment the negatively charged amino acids are glutamic acid or aspartic acid.

The Class 4 peptides disclosed herein can be combined with other active agents, including for example, insulin, to treat diseases or conditions that are characterized by excessive glucagon activity. In one embodiment, Class 4 peptides that have been modified to be covalently bound to a PEG chain having a molecular weight of greater than 10,000 Daltons can be administered in conjunction with insulin to help to maintain stable blood glucose levels in diabetics. The Class 4 peptides of the present disclosure can be co-administered with insulin as a single composition, simultaneously administered as separate solutions, or alternatively, the insulin and the Class 4 peptide can be administered at different times relative to one another. In one embodiment the composition comprising insulin and the composition comprising the Class 4 peptide are administered within 12 hours of one another. The exact ratio of the Class 4 peptide relative to the administered insulin will be dependent in part on determining the glucagon levels of the patient, and can be determined through routine experimentation.

Dimer Peptides

The present disclosure also encompasses multimers of the modified Class 4 peptides disclosed herein. Two or more of the modified Class 4 peptides can be linked together using standard linking agents and procedures known to those skilled in the art. For example, dimers can be formed between two modified Class 4 peptides through the use of bifunctional thiol crosslinkers and bi-functional amine crosslinkers, particularly for Class 4 peptides that have been substituted (at positions 11, 16 or 19, for example) with cysteine, lysine ornithine, homocysteine or acetyl phenylalanine residues (e.g. SEQ ID NO: 909, SEQ ID NO: 910, SEQ ID NO: 911 and SEQ ID NO: 912). The dimer can be a homodimer or alternatively can be a heterodimer. In one embodiment the dimer is formed between two Class 4 peptides independently selected from the group consisting of SEQ ID NO: 908, SEQ ID NO: 909, SEQ ID NO: 910, SEQ ID NO: 911, SEQ ID NO: 912, SEQ ID NO: 945, SEQ ID NO: 946, or SEQ ID NO: 947, wherein the two peptides are linked to one another via a linker attached to position 11 of each peptide, 16 of each peptide, or position 19 of each peptide or any combination thereof. In one embodiment the linkage is a disulfide linkage between a Cys 11 to Cys11 or a Cys19 to Cys19 or a Cys11 to Cys19 residue of the respective Class 4 peptide peptides.

Similarly, a dimer can be formed between two Class 4 peptide peptides independently selected form the group consisting of SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 936, SEQ ID NO: 937, SEQ ID NO: 938, SEQ ID NO: 939 and SEQ ID NO: 942 wherein the linkage is formed between amino acid positions independently selected from positions 16, 21 and 24 with respect to the native glucagon peptide.

In accordance with one embodiment a Class 4 peptide dimer is provided comprising two Class 4 peptides, each comprising the sequence of SEQ ID NO: 946, wherein the two antagonists are linked to one another by a disulfide bond through amino acid position 25. In another embodiment a Class 4 peptide dimer is provided comprising two Class 4 peptides, each comprising the sequence of SEQ ID NO: 947, wherein the two antagonists are linked to one another by a disulfide bond through amino acid position 35. In one embodiment the dimer is formed from Class 4 peptides of SEQ ID NO: 946 and SEQ ID NO: 947 wherein the amino acid at position 10 is glutamic acid.

In one embodiment the dimer comprises a homodimer of a Class 4 peptide fusion peptide selected from the group consisting of SEQ ID NO: 907, SEQ ID NO: 908, SEQ ID NO: 936, SEQ ID NO: 937, SEQ ID NO: 940, SEQ ID NO: 939, SEQ ID NO: 940, SEQ ID NO: 941, SEQ ID NO: 942 and pharmaceutically acceptable salts of said Class 4 peptides. In accordance with one embodiment a dimer is provided comprising a first Class 4 peptide bound to a second Class 4 peptide via a linker, wherein the first and second peptides of the dimer are independently selected from the group consisting of SEQ ID NO: 907, SEQ ID NO: 908, SEQ ID NO: 936, SEQ ID NO: 937, SEQ ID NO: 939, SEQ ID NO: 940, SEQ ID NO: 941, and SEQ ID NO: 942, and pharmaceutically acceptable salts of said glucagon polypeptides. In another embodiment the first and second Class 4 peptides of the dimer are independently selected from the group consisting of SEQ ID NO: 907, SEQ ID NO: 908, SEQ ID NO: 936 and SEQ ID NO: 939.

In another embodiment the dimer comprises a homodimer of a Class 4 peptide selected from the group consisting of SEQ ID NO: 923, SEQ ID NO: 924, SEQ ID NO: 925, SEQ ID NO: 926, SEQ ID NO: 927, SEQ ID NO: 928, SEQ ID NO: 929, SEQ ID NO: 930, SEQ ID NO: 931. In another embodiment, a Class 4 peptide dimer is provided wherein the first and second peptides of the dimer comprise an amino acid sequence independently selected from the group consisting of SEQ ID NO: 923, SEQ ID NO: 924, SEQ ID NO: 925, SEQ ID NO: 926, SEQ ID NO: 927 and SEQ ID NO: 928. In another embodiment the dimer comprises a homodimer of a Class 4 peptide selected from the group consisting of SEQ ID NO: 909, SEQ ID NO: 911 and SEQ ID NO: 912, wherein the peptide further comprises a polyethylene glycol chain covalently bound to position 11 or 19 of the glucagon peptide.

The Class 4 glucagon related analog peptide may comprise the amino acid sequence of any of the amino acid sequences of SEQ ID NOs: 901-971, optionally with up to 1, 2, 3, 4, or 5 further modifications that retain glucagon antagonist activity.

Class 5 Glucagon Related Analog Peptides

In certain embodiments, a glucagon related analog peptide is a class 5 glucagon related analog peptide (see, e.g., International (PCT) Patent Application No. PCT/US2008/081333, incorporated herein by reference in its entirety).

Activity

In certain aspects a class 5 glucagon related analog peptide (hereafter referred to as a "class 5 peptide") may be a glucagon antagonists/GLP-1 agonists are utilized in any setting where the suppression of glucagon agonism is desired while simultaneous stimulation of GLP-1 activity is also desired. For example, glucagon antagonist activity in conjunction with GLP-1 stimulation can be used in the treatment of diabetes where glucagon antagonism has been demonstrated in pre-clinical models of hyperglycemia to yield a lowering of blood glucose and GLP-1 activity is associated with insulin production. Compounds demonstrating GLP-1 activity have also been known to be useful for treating obesity and preventing weight gain.

In certain aspects class 5 peptides are believed to be suitable for any use that has previously been described for other glucagon antagonist/GLP-1 agonists. These two activities have separately been shown to be highly desirable properties for the treatment of the metabolic syndrome, specifically diabetes and obesity. The glucagon antagonist activity is useful in any setting where the suppression of glucagon agonism is desired. The presence of GLP-1 agonism further suppresses the endogenous secretion of glucagon from the pancreas while stimulating insulin synthesis and secretion. The two pharmacological actions serve in a synergistic fashion to normalize metabolic abnormalities. Accordingly, the Class 5 peptides can be used to treat hyperglycemia, or treat other metabolic diseases that result from high blood levels of glucagon or high blood glucose levels. In accordance with one embodiment the patient to be treated using the glucagon antagonist/GLP-1 agonists such as class 5 peptides disclosed herein is a domesticated animal, and in another embodiment the patient to be treated is a human. Studies suggest that lack of glucagon suppression in diabetic patients contributes to postprandial hyperglycemia in part via accelerated glycogenolysis. Analysis of blood glucose during an Oral Glucose Tolerance Test (OGTT), and in the presence or absence of somatostatin-induced glucagon suppression has shown a significant increase in glucose in subjects with higher glucagon levels. Accordingly, a glucagon antagonist/GLP-1 agonists or Class 5 peptides described herein can be used to treating hyperglycemia, and are expected to be useful for treating a variety of types of diabetes including diabetes mellitus type I, diabetes mellitus type II, or gestational diabetes, either insulin-dependent or non-insulin-dependent, and reducing complications of diabetes including nephropathy, retinopathy and vascular disease.

Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

Pharmaceutical compositions comprising class 5 peptides can be formulated and administered to patients using standard pharmaceutically acceptable carriers and routes of administration known to those skilled in the art. Accordingly, the present disclosure also encompasses pharmaceutical compositions comprising one or more class 5 peptides disclosed herein in combination with a pharmaceutically acceptable carrier. The pharmaceutical compositions may comprise the class 5 peptides as the sole pharmaceutically active component, or the class 5 peptides can be combined with one or more additional active agents. In accordance with one embodiment a composition is provided comprising a Class 5 peptide and insulin or an insulin analog. Alternatively, a composition is provided for inducing weight loss or preventing weight gain can be provided that comprises the sequence of SEQ ID NO: 1015 or SEQ ID NO: 1051 further comprising the amino acid sequence of SEQ ID NO: 1021 (GPSSGAPPPS) or SEQ ID NO: 1050 linked to amino acid 24 of SEQ ID NO: 1015 or SEQ ID NO: 1051, and an anti-obesity peptide. Suitable anti-obesity peptides include those disclosed in U.S. Pat. Nos. 5,691,309, 6,436,435 or US Patent application 20050176643.

Class 5 Peptide Structure

In accordance with one embodiment a Class 5 peptide is provided comprising a glucagon peptide that has been modified by the deletion of the first 1 to 5 amino acids residues (e.g., first amino acid, first two amino acids, first three amino acids, first four amino acids, first five amino acids) from the N-terminus, and stabilization of the alpha-helix structure in the C-terminal portion of the compound (around amino acid positions 12-29 according to the amino acid numbering of wild type glucagon, SEQ ID NO: 1001), e.g., by the linkage of the side chains of amino acid pairs, selected from positions 12 and 16, 16 and 20, 20 and 24, and 24 and 28 (relative to the native glucagon peptide sequence), to one another through hydrogen-bonding or ionic interactions, such as the formation of salt bridges, or by covalent bonds. Alternatively, stabilization of the alpha-helix around residues 12-29 is achieved through introduction of one or more α,α-disubstituted amino acids at positions that retain the desired activity. In some embodiments, one, two, three, four or more of positions 16, 17, 18, 19, 20, 21, 24 or 29 (according to the amino acid numbering of wild type glucagon) of the Class 5 peptide or analog thereof is substituted with an α,α-disubstituted amino acid. For example, substitution of position 16 (according to the amino acid numbering of wild type glucagon) of a Class 5 peptide or analog thereof with amino iso-butyric acid (AIB) provides a stabilized alpha helix in the absence of a salt bridge or lactam. In some embodiments, one, two, three or more of positions 16, 20, 21 or 24 (according to the amino acid numbering of wild type glucagon) are substituted with AIB In accordance with one embodiment, a class 5 peptide is provided wherein the peptide exhibits at least 80% of the maximum agonism achieved by native GLP-1 at the GLP-1 receptor, and exhibits glucagon antagonist activity that reduces the maximum glucagon-induced cAMP production at the glucagon receptor by at least about 50%, as measured by cAMP production in an in vitro assay. In one embodiment, the class 5 peptide exhibits at least 90% of the activity of native GLP-1 at the GLP-1 receptor, and exhibits glucagon antagonist activity, that reduces the maximum glucagon-induced cAMP production at the glucagon receptor by at least about 80%.

In accordance with one embodiment the class 5 peptide comprises a derivative peptide of SEQ ID NO: 1002 wherein the peptide comprises further amino acid substitutions relative to SEQ ID NO: 1002 at one to three amino acid positions selected from positions 1, 2, 4, 5, 6, 7, 8, 9, 10, 11, 12, 13, 14, 15, 16, 19, 22 and 24, and exhibits at least 90% of the activity of native GLP-1 at the GLP-1 receptor, and exhibits glucagon antagonist activity, that reduces the maximum glucagon-induced cAMP production at the glucagon receptor by at least about 80%.

In some embodiments, the alpha-helix structure in the C-terminal portion of the Class 5 peptide (around amino acids 12-29 according to the amino acid numbering of wild type glucagon) is stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). In some embodiments, one, two, three, four or more of positions 16, 17, 18, 19, 20, 21, 24 or 29 (according to the amino acid numbering of wild type glucagon) of the Class 5 peptide or analog thereof is substituted with an α,α-disubstituted amino acid e.g., amino isobutyric acid (AIB). For example, substitution of position 16 (according to the amino acid numbering of wild type glucagon) of a Class 5 peptide or analog thereof with amino iso-butyric acid (AIB) provides a stabilized alpha helix in the absence of a salt bridge or lactam.

In one embodiment the class 5 peptide comprises SEQ ID NO: 1015 or SEQ ID NO: 1051, and more particularly, a sequence selected from the group consisting of SEQ ID NO: 1005, SEQ ID NO: 1006, SEQ ID NO: 1007, SEQ ID NO: 1008, SEQ ID NO: 1009, SEQ ID NO: 1016, SEQ ID NO: 1017, SEQ ID NO: 1018, SEQ ID NO: 1019, SEQ ID NO: 1022, SEQ ID NO: 1023, SEQ ID NO: 1024 and SEQ ID NO: 1025. In further embodiments the class 5 peptide comprises a derivative peptide of SEQ ID NO: 1015 or SEQ ID NO: 1051 wherein the peptide comprises a further amino acid substitution relative to SEQ ID NO: 1015 or SEQ ID NO: 1051 at one to three amino acid positions selected from positions 1, 2, 5, 6, 8, 9, 12, 13 and 14. In one embodiment the substitutions at positions 1, 2, 5, 6, 8, 9, 12, 13 and 14 are conservative amino acid substitutions. In one embodiment the threonine at position 24 of SEQ ID NO: 1005 or SEQ ID NO: 1006 is substituted with glycine.

In accordance with one embodiment the class 5 peptide represents a further modification of the peptide wherein in addition to the N-terminal deletion, the phenylalanine at position 6 of the native glucagon peptide is modified, e.g., to comprise a hydroxyl group in place of the N-terminus amino group. In a further embodiment the natural carboxylic acid of the C-terminal amino acid is replaced with a charge-neutral group, such as an amide or ester.

In accordance with one embodiment, Class 5 peptides have been prepared wherein the first three to five amino acids of native glucagon have been deleted, the amino acid at position 9, relative to the native glucagon peptide, has been substituted with an amino acid selected from the group consisting of glutamic acid, homoglutamic acid, β-homoglutamic acid, a sulfonic acid derivative of cysteine, or an alkylcarboxylate derivative of cysteine having the structure of:

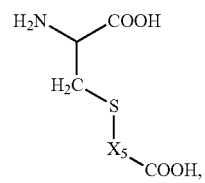

wherein $X_5$ is $C_1$-$C_4$ alkyl, $C_2$-$C_4$ alkenyl, or $C_2$-$C_4$ alkynyl, and the alpha-helix structure in the C-terminal portion of glucagon (around amino acids 12-29 according to the amino acid numbering of wild type glucagon) is stabilized, e.g., via a lactam bridge is formed between the side chains of amino acids 12 and 16 or between amino acids 16 and 20, relative to the native glucagon peptide. Examples of amino acid pairings that are capable of covalently bonding to form a seven-atom linking bridge are detailed through-out this disclosure. In one embodiment, the sulfonic acid derivative of cysteine is cysteic acid or homocysteic acid.

In one embodiment a class 5 is provided comprising an amino acid sequence selected from the group consisting of SEQ ID NO: 1005, SEQ ID NO: SEQ ID NO: 1006, SEQ ID NO: 1007, or SEQ ID NO: 1008, wherein said peptide comprises a lactam ring formed between the side chains of amino acids 7 and 11 for SEQ ID NO: 1005, between 11 and 15 for SEQ ID NO: 1006, between positions 15 and 19 for SEQ ID NO: 1007 and between positions 19 and 24 for SEQ ID NO: 1008, each of said sequences being further modified to comprise a hydrophilic moiety covalently bound to the peptide. More particularly, in one embodiment each of the lactam bearing class 5 peptide are modified by covalent attachment of a polyethylene glycol chain. For example, for a class 5 peptide comprising SEQ ID NO: 1005, the peptide is pegylated at a position selected from the group consisting of 12, 15, 16, 19 and 24; for a class 5 peptide comprising SEQ ID NO: 1006, the peptide is pegylated at a position selected from the group consisting of 12, 16, 19 and 24; for a class 5 peptide comprising SEQ ID NO: 1007, the peptide is pegylated at a position selected from the group consisting of 11, 12, 16 and 24; for class 5 peptide comprising SEQ ID NO: 1008, the peptide is pegylated at a position selected from the group consisting of 11, 12, 15 and 16. In accordance with one embodiment a class 5 peptide comprising SEQ ID NO: 1047 or SEQ ID NO: 1048 is provided wherein the peptide is pegylated at a position selected from the group consisting of 12, 16, 19 and 24, relative to the SEQ ID NO: 1047 or SEQ ID NO: 1048 sequence. In a further embodiment the peptide of SEQ ID NO: 1047 or SEQ ID NO: 1048 is further modified by the addition of the sequence of SEQ ID NO: 1021 to the carboxy terminus of the peptide.

As detailed above in certain aspects Class 5 peptides are provided wherein the first five amino acids of native glucagon have been deleted, the amino group of the N-terminal amino acid (phenylalanine) has been replaced with a hydroxyl group (i.e., the first amino acid is phenyl-lactic acid) and the side chains of one or more amino acid pairs selected from positions 12 and 16, 16 and 20, 20 and 24, and 24 and 28 are linked to one another, thus stabilizing the Class 5 peptide alpha helix.

In accordance with one embodiment a class 5 peptide is provided comprising the sequence of SEQ ID NO: 1002 that is modified by a substitution of the serine residue at position 11 of SEQ ID NO: 1002 (position 16 according to the amino acid numbering of native glucagon) with an amino acid selected from the group consisting of glutamic acid, glutamine, homoglutamic acid, homocysteic acid, threonine or glycine. In accordance with one embodiment the serine residue at position 11 of SEQ ID NO: 1002 is substituted with an amino acid selected from the group consisting of glutamic acid, glutamine, homoglutamic acid and homocysteic acid, and in one embodiment the serine residue is substituted with glutamic acid. In accordance with one embodiment the class 5 peptide comprises the sequence of SEQ ID NO: 1038.

In one embodiment a class 5 peptide is provided wherein an intramolecular bridge is formed between two amino acid side chains to stabilize the three dimensional structure of the carboxy terminus of the peptide of SEQ ID NO: 1002. More particularly, the side chains of one or more amino acids selected from amino acid pairs 7 and 11, 11 and 15, 15 and 19 or 19 and 23 of SEQ ID NO: 1002 are linked to one another, thus stabilizing the alpha helix in the C-terminal portion. The two side chains can be linked to one another through hydrogen-bonding, ionic interactions (such as the formation of salt bridges), or by covalent bonds. In accordance with one embodiment the size of the linker is 7-9 atoms, and in one embodiment the size of the linker is 8 atoms. In one embodiment the class 5 peptide is selected from the group consisting of SEQ ID NO: 1005, SEQ ID NO: 1006, SEQ ID NO: 1007 and SEQ ID NO: 1008. In one embodiment the C-terminal amino acid of the class 5 peptide have an amide group substituting for the carboxylic acid group that is present on the native amino acid.

In accordance with one embodiment class 5 peptide is provided wherein the analog comprises an amino acid sequence of SEQ ID NO: 1009. In one embodiment the three dimensional structure of the carboxy terminus of the peptide of SEQ ID NO: 1009 is stabilized by the formation of covalent bonds between the side chains of the peptide. In one embodiment two amino acid side chains are bound to one another to form a lactam ring. The size of the lactam ring can vary depending on the length of the amino acid side chains, and in one embodiment the lactam is formed by linking the side chains of a lysine amino acid to a glutamic acid side chain. In one embodiment the C-terminal amino acid of the class 5 peptides have an amide group substituting for the carboxylic acid group that is present on the native amino acid.

The order of the amide bond in the lactam ring can be reversed (e.g., a lactam ring can be formed between the side chains of a Lys12 and a Glu16 or alternatively between a Glu 12 and a Lys16). In accordance with one embodiment a glucagon analog of SEQ ID NO: 1009 is provided wherein at least one lactam ring is formed between the side chains of an amino acid pair selected from the group consisting of amino acid pairs 7 and 11, 11 and 15, 15 and 19 or 19 and 23 of SEQ ID NO: 1009. In one embodiment a class 5 peptide is provided wherein the peptide comprises the sequence of SEQ ID NO: 1010, said sequence further comprising an intramolecular lactam bridge formed between amino acid positions 7 and 11, or between amino acid positions 11 and 15, or between amino acid positions 15 and 19 of SEQ ID NO: 1010. In one embodiment a class 5 peptide is provided wherein the peptide comprises the sequence of SEQ ID NO: 1011, said sequence further comprising an intramolecular lactam bridge formed between amino acid positions 7 and 11, or between amino acid positions 11 and 15 of SEQ ID NO: 1011. In one embodiment the class 5 peptide comprises the sequence of SEQ ID NO: 17.

Additional class 5 peptide are provided comprising derivatives of SEQ ID NO: 1005, wherein the aspartic acid at position 10 of SEQ ID NO: 1005 (position 15 of native glucagon) has been substituted with glutamic acid, an amino acid of the general structure:

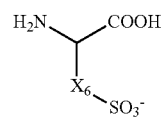

wherein $X_6$ is $C_1$-$C_3$ alkyl, $C_2$-$C_3$ alkene or $C_2$-$C_3$ alkynyl, and in one embodiment $X_6$ is $C_1$-$C_3$ alkyl, and in another embodiment $X_6$ is $C_2$ alkyl. In one embodiment a Class 5 peptide derivative of SEQ ID NO: 1009 is provided wherein position 10 of SEQ ID NO: 1009 (position 15 of native glucagon) is substituted with an amino acid selected from the group consisting of glutamic acid, cysteic acid, homocysteic acid and homoglutamic acid. In a further embodiment position 10 of SEQ ID NO: 1009 is substituted with an amino acid selected from the group consisting of cysteic acid or homocysteic acid. In one embodiment a Class 5 peptide derivative of SEQ ID NO: 1006, SEQ ID NO: 1007 or SEQ ID NO: 1008 is provided wherein position 10 of SEQ ID NO: 1006, SEQ ID NO: 1007 or SEQ ID NO: 1008 is substituted with an amino acid selected from the group consisting of glutamic acid, cysteic acid, homocysteic acid and homoglutamic acid. In one embodiment the C-terminal amino acid of a class 5 peptide have an amide group substituting for the carboxylic acid group that is present on the native amino acid.

In one embodiment an amino acid of class 5 peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, an amino acid of a class 5 peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In accordance with one embodiment the lysine residue corresponding to position 7 of the peptide of SEQ ID NO: 1005 is substituted with arginine and a single lysine substitution is inserted for one of the amino acids corresponding to position 12, 15, 16, 19 and 24 of SEQ ID NO: 1005.

In another embodiment the methionine residue corresponding to position 22 of the class 5 peptides disclosed herein is changed to leucine or norleucine to prevent oxidative degradation of the peptide.

Moreover class 5 peptides, in some aspects, also encompass amino acid substitutions at positions that are known not to be critical to the function of the glucagon analog. In one embodiment the substitutions are conservative amino acid substitutions at one, two or three positions selected from the group consisting of 2, 5, 6, 7, 8, 9, 12, 13, 14, 15, 16, 19, 22, 23 or 24. In one embodiment the amino acids corresponding to positions 16, 17, 20, 21, 24 or 29 of the native glucagon peptide, and more particularly at position 21 and/or 24 relative to native glucagon are substituted with cysteine or lysine, wherein a PEG chain is covalently attached to the substituted cysteine or lysine residue.

In accordance with one embodiment, a class 5 peptide is provided comprising a sequence consisting of SEQ ID NO: 1009, further modified by one or more additional amino acid substitutions at positions corresponding to positions 11, 12, 15, 16, 19 and/or 24 of the peptide (including for example substitution with cysteine), wherein the amino acid substitution comprises an amino acid having a side chain suitable for crosslinking with hydrophilic moieties, including for example, PEG. Native glucagon can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. In one embodiment a Class 5 peptide is provided wherein the peptide comprises the sequence of SEQ ID NO: 1009 and further comprises a polyethylene chain bound to position 16 or 19 of the peptide. In a further embodiment the C-terminus of the glucagon analog is modified to replace the carboxylic acid group with an amide group.

In accordance with one embodiment a class 5 peptide is provided comprising a glucagon analog selected from the group consisting of:

(SEQ ID NO: 1039)
R$_1$-Phe-Thr-Ser-Xaa-Tyr-Ser-Lys-Tyr-Leu-Xaa-Glu-

Arg-Arg-Ala-Gln-Asp-Phe-Val-Gln-Trp-Leu-Xaa-Asn-

Thr-R$_2$ (SEQ ID NO: 1013)
R$_1$-Phe-Thr-Ser-Xaa-Tyr-Ser-Lys-Tyr-Leu-Asp-Glu-

Arg-Arg-Ala-Gln-Xaa-Phe-Val-Gln-Trp-Leu-Xaa-Asn-

Thr-R$_2$, (SEQ ID NO: 1014)
R$_1$-Phe-Thr-Ser-Xaa-Tyr-Ser-Lys-Tyr-Leu-Asp-Glu-

Arg-Arg-Ala-Gln-Asp-Phe-Val-Xaa-Trp-Leu-Xaa-Asn-

Thr-R$_2$
and (SEQ ID NO: 1012)
R$_1$-Phe-Thr-Ser-Xaa-Tyr-Ser-Lys-Tyr-Leu-Asp-Glu- Arg-Arg-Ala-Gln-Xaa-Phe-Val-Xaa-Trp-Leu-Xaa-Asn- Thr-R$_2$, wherein Xaa at position 4=aspartic acid, glutamic acid, cysteic acid or homocysteic acid, Xaa at position 10=Asp, Glu, cysteic acid, homoglutamic acid and homocysteic acid, Xaa at position 16 is Asp, Cys, Orn, homocysteine or acetyl phenylalanine and the Xaa at position 19 is Gln, Cys, Orn, homocysteine and acetyl phenylalanine, Xaa at position 22=Met, Leu or Nle, R$_1$ is OH or NH$_2$, and R$_2$ is Gly Pro Ser Ser Gly Ala Pro Pro Pro Ser (SEQ ID NO: 1021), Gly Pro Ser Ser Gly Ala Pro Pro Pro Ser Xaa (SEQ ID NO: 1050; wherein Xaa is Cys, Orn, homocystein or acetyl phenylalanine), COOH or CONH$_2$, wherein the peptide is optionally pegylated at position 16 of SEQ ID NO: 1013, position 19 of SEQ ID NO: 1014 and at positions 16 and 19 of SEQ ID NO: 1012. In one embodiment the Thr at position 24 of SEQ ID NOs: 1012-1014 and 1039 is substituted with Gly. In accordance with one embodiment the peptide comprises the sequence of SEQ ID NO: 1013 or SEQ ID NO: 1014, wherein R$_1$ is OH. In accordance with one embodiment the peptide comprises the sequence of SEQ ID NO: 1013 or SEQ ID NO: 1014, wherein R$_1$ is OH and R$_2$ is CONH$_2$. In accordance with one embodiment the peptide comprises the sequence of SEQ ID NO: 1013 or SEQ ID NO: 1014, wherein R$_1$ is OH, R$_2$ is CONH$_2$ and the threonine at position 24 is substituted with glycine.

In one embodiment, a class 5 peptide is further modified to comprise one or more amino acids of native GLP-1 by substitution of the native glucagon residue(s) at corresponding amino acid positions. For example, the class 5 peptide may comprise one or more amino acid substitutions at any of positions 2, 3, 17, 18, 21, 23, and 24 (according to the amino acid numbering of native glucagon). In a specific embodiment, the class 5 peptide is modified by one or more of the following amino acid substitutions: Ser2 is replaced with Ala, Gln3 is replaced with Glu, Arg17 is replaced with Gln, Arg at position 18 is replaced with Ala, Asp at position 21 is replaced with Glu, Val at position 23 is replaced with Ile, and Gln at position 24 is replaced with Ala (amino acid positions are in accordance with the native glucagon sequence). In a specific embodiment, the class 5 peptide is modified by replacing Ser2 with Ala and Gln3 with Glu (according to the amino acid numbering of native glucagon). In another specific embodiment, the class 5 peptide is modified with all of the following amino acid substitutions: Arg17 is replaced with Gln, Arg at position 18 is replaced with Ala, Asp at position 21 is replaced with Glu, Val at position 23 is replaced with Ile, and Gln at position 24 is replaced with Ala (amino acid numbering according to native glucagon). In yet another specific embodiment, the class 5 peptide is modified to comprise just Glu at position 21 (according to the numbering of SEQ ID NO: 1001). Accordingly, the class 5 peptide can comprise the amino acid sequence of any of SEQ ID NOs: 1060-1070, 1073-1078, 1080-1088, 1090-1096, 1103, 1104, 1106, and 1114-1118.

Also provided herein is a class 5 peptide or conjugate thereof comprising (1) a stabilized alpha helix through means described herein (e.g., through an intramolecular bridge, or incorporation of one or more alpha, alpha-di-substituted amino acids, or an acidic amino acid at position 16 (according to the numbering of SEQ ID NO:1001), or a combination thereof; (2) a C-terminal amide or ester in place of a C-terminal carboxylate, and (3) a general structure of A-B-C, wherein A is selected from the group consisting of
(i) phenyl lactic acid (PLA);
(ii) an oxy derivative of PLA; and
(iii) a peptide of 2 to 6 amino acids in which two consecutive amino acids of the peptide are linked via an ester or ether bond;
wherein B represents amino acids p to 26 of SEQ ID NO: 1001, wherein p is 3, 4, 5, 6, or 7, optionally comprising one or more amino acid modifications, as described herein, including, for example, any of the modifications described for Class 5 peptides. For instance the one or more modification may be selected from the group consisting of:
(iv) Asp at position 9 (according to the amino acid numbering of SEQ ID NO: 1001) is substituted with a Glu, a sulfonic acid derivative of Cys, homoglutamic acid, β-homoglutamic acid, or an alkylcarboxylate derivative of cysteine having the structure of:

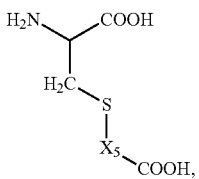

wherein $X_5$ is $C_1$-$C_4$ alkyl, $C_2$-$C_4$ alkenyl, or $C_2$-$C_4$ alkynyl;
(v) substitution of one or two amino acids at positions 10, 20, and 24, (according to the amino acid numbering of SEQ ID NO: 1001) with an amino acid covalently attached to an acyl or alkyl group via an ester, ether, thioether, amide, or alkyl amine linkage;
(vi) substitution of one or two amino acids at positions 16, 17, 20, 21, and 24 (according to the amino acid numbering of SEQ ID NO: 1001) with an amino acid selected from the group consisting of: Cys, Lys, ornithine, homocysteine, and acetyl-phenylalanine (Ac-Phe), wherein the amino acid of the group is covalently attached to a hydrophilic moiety;
(vii) Asp at position 15 (according to the numbering of SEQ ID NO: 1001) is substituted with cysteic acid, glutamic acid, homoglutamic acid, and homocysteic acid;
(viii) Ser at position 16 (according to the numbering of SEQ ID NO: 1001) is substituted with cysteic acid, glutamic acid, homoglutamic acid, and homocysteic acid;
(ix) Arg at position 17 is replaced with Gln, Arg at position 18 is replaced with Ala, Asp at position 21 is replaced with Glu, Val at position 23 is replaced with Ile, and Gln at position 24 is replaced with Ala (according to amino acid numbering of SEQ ID NO: 1001);
(x) Ser at position 16 is replaced with Glu, Gln at position 20 is replaced with Glu, or Gln at position 24 is replaced with Glu (according to the amino acid numbering of SEQ ID NO: 1001);
wherein C (of the general structure of A-B-C) is selected from the group consisting of:
(vii) X;
(viii) X—Y;
(ix) X—Y—Z;
(x) X—Y—Z—R10;
wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid;

wherein R10 is selected from a group consisting of SEQ ID NOs: 1021, 1026, 1027, and 1050.

In a specific aspect, the peptide comprises an oxy derivative of PLA. As used herein "oxy derivative of PLA" refers to a compound comprising a modified structure of PLA in which the hydroxyl group has been replaced with O—$R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula XI:

Formula XI

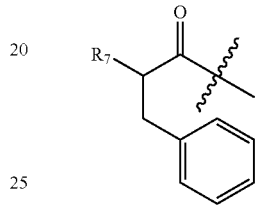

wherein R7 is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art. For example, the hydroxyl group of PLA may be reacted with a halogenated alkyl or tosylated alkyl alcohol to form an ether bond.

In a specific embodiment, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In a specific embodiment, the chemical moiety is an amino acid, which, optionally, is a part of a peptide, such that Formula XI is a depsipeptide. In this regard, PLA may be at a position other than the N-terminal amino acid residue of the peptide, such that the peptide comprises one or more (e.g., 1, 2, 3, 4, 5, 6, or more) amino acids N-terminal to the PLA residue. For example, the peptide can comprise PLA at position n, wherein n is 2, 3, 4, 5, or 6 of the peptide.

The amino acids N-terminal to the PLA residue may be synthetic or naturally-occurring. In a specific embodiment, the amino acids which are N-terminal PLA are naturally-occurring amino acids. In one embodiment, the amino acids which are N-terminal to PLA are the N-terminal amino acids of native glucagon. For example, the peptide can comprise at the N-terminus the amino acid sequence of any of SEQ ID NOs: 1052-1056, wherein PLA is linked to threonine via an ester bond:

His-Ser-Gln-Gly-Thr-PLA    SEQ ID NO: 1052

Ser-Gln-Gly-Thr-PLA    SEQ ID NO: 1053

Gln-Gly-Thr-PLA    SEQ ID NO: 1054

Gly-Thr-PLA    SEQ ID NO: 1055

Thr-PLA    SEQ ID NO: 1056

In an alternative embodiment, one or more of the N-terminal amino acids may be substituted with an amino acid other than the amino acid of native glucagon. For example, when the peptide comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the peptide is an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist/agonist peptide is an amino acid selected from the group consisting of D-serine, D-alanine, valine, glycine, N-methyl serine, N-methyl alanine, and aminoisobutyric acid (AIB). Also, for example, when the peptide comprises PLA as the amino acid at position 4, 5, or 6, the amino acid at position 3 of the peptide may be glutamic acid, as opposed to the native glutamine residue of native glucagon. In an exemplary embodiment of the invention, the peptide comprises at the N-terminus the amino acid sequence of any of SEQ ID NOs: 1057-1059.

With respect to the peptides comprising a compound of Formula XI, the polymer may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly (isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly (lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly (isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In one embodiment, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene copolymer, polyoxyethyleneglycols, polyethylene oxide, and derivatives, salts, and combinations thereof.

In a specific embodiment, the polymer is a polyalkylene glycol, including, for example, polyethylene glycol (PEG).

The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

The lipid may be any lipid comprising a carbonyl with an alpha leaving group. The lipid, for example, may be one which is derivatized to comprise the carbonyl. In this regard, the lipid, may be a derivative of a fatty acid (e.g., a C4-C30 fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide.

oil, wax, cholesterol, sterol, fat-soluble vitamin, monoglyceride, diglyceride, triglyceride, a phospholipid.

In one embodiment, R7 has a molecular weight of about 100 kDa or less, e.g., about 90 kDa or less, about 80 kDa or less, about 70 kDa or less, about 60 kDa or less, about 50 kDa or less, about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In an alternative embodiment, the peptide comprising the general structure of A-B-C comprises, as A, a peptide of 2 to 6 amino acids in which two consecutive amino acids of the peptide of A are linked via an ester or ether bond. The ester or ether bond may be, e.g., between amino acids 2 and 3, 3 and 4, 4 and 5, or 5 and 6. Optionally the peptide of A may be further modified by covalent linkage to another chemical moiety including linkage to a polymer (e.g. a hydrophilic polymer), alkylation, or acylation.

In a specific embodiment, the above-described class 5 peptide comprising PLA is modified to comprise an oxy derivative of PLA, such as, for instance, an ester of PLA or an ether of PLA. For example, the class 5 peptide can comprise the amino acid sequence of any of SEQ ID NOs: 1002, 1005-1020, 1022-1025, 1032-1036, 1038, 1039, 1045, 1046, and 1051, wherein the PLA is linked via an ester or ether bond to an amino acid, peptide, polymer, acyl group, or alkyl group. The amino acid, peptide, polymer, acyl group, or alkyl group may be any of those described herein. In the case that the PLA is linked via an ester bond to an amino acid or peptide, the class 5 peptide may be considered as a depsipeptide.

Also, in another specific embodiment, the above-described class 5 peptide which lacks PLA is modified to comprise at least one ester bond or ether bond between two consecutive amino acids which are N-terminal to the amino acid at position 7 (according to the numbering of native glucagon). In a specific embodiment, the class 5 peptide comprises at least one ester or ether bond between the two consecutive amino acids. In a more specific embodiment, the Class 5 peptide comprises the N-terminal 6 amino acids of SEQ ID NO: 1001 and two consecutive amino acids of the N-terminal 6 amino acids are linked via an ester or ether bond.

The peptide of A may comprise any amino acids, synthetic or naturally occurring, provided that at least two consecutive amino acids are linked via an ester or ether bond. In a specific embodiment, the peptide of A comprises amino acids of native glucagon. The amino acid at position 1 and/or position 2 may be an amino acid which reduces susceptibility to cleavage by dipeptidyl peptidase IV. For instance, the peptide of A can comprise at position 1 an amino acid selected from the group consisting of: D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the peptide of A is an amino acid selected from the group consisting of: D-serine, D-alanine, valine, glycine, N-methyl serine, N-methyl alanine, and aminoisobutyric acid (AIB). Also, for example, the amino acid at position 3 of the peptide of A may be glutamic acid, as opposed to the native glutamine residue of native glucagon. Accordingly, the peptide of general structure of A-B-C can comprise an amino acid sequence of:

```
                                    (SEQ ID NO: 1107)
       Xaa1-Xaa2-Xaa3-Thr-Gly-Phe;

(SEQ ID NO: 1108)
       Xaa2-Xaa3-Thr-Gly-Phe;
       or (SEQ ID NO: 1109)
       Xaa3-Thr-Gly-Phe;
``` wherein Xaa₁ is selected from a group consisting of: His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; Xaa₂ is selected from a group consisting of: Ser, D-serine, D-alanine, valine, glycine, N-methyl serine, N-methyl alanine, and aminoisobutyric acid (AIB); and Xaa₃ is Gln or Glu.

In one embodiment, B is modified by up to three amino acid modifications. For example, B, which represents native amino acid sequence of SEQ ID NO: 1001 is modified by one or more conservative amino acid modifications.

In another embodiment, B comprises one or more amino acid modifications selected from the group consisting of (iv) to (x), as described herein. In a specific embodiment, B comprises one or both of the amino acid modifications (v) and (vi). In a further specific embodiment, B comprises one or a combination of amino acid modifications selected from the group consisting of (iv), (vii), (viii), (ix), and (x), in addition to (v) and (vi).

As described herein, the peptide comprising the general structure A-B-C may comprise one or more charged amino acids at the C-terminus, e.g., as Y and/or Z, as described herein. Alternatively or additionally, the peptide comprising the general structure A-B-C may further comprise one to two charged amino acids C-terminal to Z, when C comprises X—Y—Z. The charged amino acids can be, for example, one of Lys, Arg, His, Asp, and Glu. In a specific embodiment, Y is Asp.

In one embodiment, the peptide comprising the general structure A-B-C comprises a hydrophilic moiety covalently bound to an amino acid residue at position 1, 16, 20, 21, or 24 (according to the amino acid numbering of SEQ ID NO: 1001), or at the N- or C-terminal residue of the peptide comprising the general structure A-B-C. In a specific embodiment, the hydrophilic moiety is attached to a Cys residue of the peptide comprising the general structure A-B-C. In this regard, the amino acid at position 16, 21, 24, or 29 of native glucagon (SEQ ID NO: 1001) may be substituted with a Cys residue. Alternatively, a Cys residue comprising a hydrophilic moiety may be added to the C-terminus of the peptide comprising the general structure A-B-C as position 30 or as position 40, e.g., when the peptide comprising the general structure A-B-C comprises a C-terminal extension (positions according to the amino acid numbering of SEQ ID NO: 1001). Alternatively, the hydrophilic moiety may be attached to the PLA of the peptide comprising the general structure A-B-C via the hydroxyl moiety of PLA. The hydrophilic moiety can be any of those described herein, including, for example, polyethylene glycol.

In a specific aspect, the peptide comprising the general structure A-B-C comprises a stabilized alpha helix by virtue of incorporation of an intramolecular bridge. In one embodiment, the intramolecular bridge is a lactam bridge. The lactam bridge may be between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1001). In a specific embodiment, the amino acids at positions 12 and 16 or at positions 16 and 20 (according to the amino acid numbering of SEQ ID NO: 1001) are linked via a lactam bridge. Other positions of the lactam bridge are contemplated.

Additionally or alternatively, the peptide comprising the general structure A-B-C can comprise an alpha, alpha di-substituted amino acid at, for example, any of positions 16, 20, 21, or 24 (according to the amino acid numbering of SEQ ID NO: 1001). In one embodiment, the alpha, alpha di-substituted amino acid is AIB. In a specific aspect, the AIB is located at position 16 (according to the numbering of SEQ ID NO: 1001).

Alternatively or additionally, the peptide comprising the general structure A-B-C may be modified to comprise an acidic amino acid at position 16 (according to the numbering of SEQ ID NO: 1001), which modification enhances the stability of the alpha helix. The acidic amino acid, in one embodiment, is an amino acid comprising a side chain sulfonic acid or a side chain carboxylic acid. In a more specific embodiment, the acidic amino acid is selected from the group consisting of Glu, Asp, homoglutamic acid, a sulfonic acid derivative of Cys, cysteic acid, homocysteic acid, Asp, and an alkylated derivative of Cys having the structure of

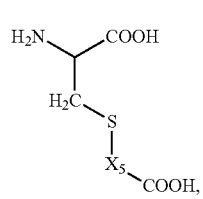

wherein $X_5$ is $C_1$-$C_4$ alkyl, C2-$C_4$ alkenyl, or C2-$C_4$ alkynyl.

In a specific embodiment, the Class 5 peptide may comprise the amino acid sequence of any of SEQ ID NOs: 1060-1070, 1073-1078, 1080-1088, 1090-1096, 1103, 1104, 1106, and 1114-1118, or comprising the amino acid sequence of any of Peptides 2-6 of Table 9, Peptides 1-8 of Table 10, and Peptides 2-6, 8, and 9 of Table 11.

TABLE 9

|   |   |   | GLP-1 EC$_{50}$ (nM) | Glu IC$_{50}$ (nM) |
|---|---|---|---|---|
| 1 | E9, K12, E16 | FTSEYSKYLDERRAQDFVQWLMNTGPSSGAPPPS | 1451 | 762 |
| 2 | E9, K12E16(lactam) | FTSEYSKYLDERRAQDFVQWLMNTGPSSGAPPPS | 63 | 2008 |
| 3 | E9, E16K20(lactam) | FTSEYSKYLDERRAKDFVQWLMNTGPSSGAPPPS | 36 | 42 |
| 4 | D9, K12E16(Lactam) | FTSDYSKYLDERRAQDFVQWLMNTGPSSGAPPPS | 118.7 | 828 |
| 5 | [PLA6, E9, K12E16(Lactam) | PLA-TSEYSKYLDERRAQDFVQWLMNTGPSSGAPPPS | 6 | 72 |
| 6 | [PLA6, E9, E16K20(Lactam)] | PLA-TSEYSKYLDERRAKDFVQWLMNTGPSSGAPPPS | 20 | 20 |

TABLE 10

|   |   | GLP-1 EC50 (nM) | Glucagon IC50 (nM) |
|---|---|---|---|
| Glucagon HSQGTFTSDYSKY1DSRRAQDFVQWLMNT |   |   | 0.2~1.0* |
| GLP-1 (aa 1-30) HAEGTFTSDVSSYLEGQAAKEFIAW1VKGR |   | 0.02~0.1 |   |
| 1 | [PLA6, D9, E16K20(lactam), D28]G(6-29) PLA TSDYSKY1DERRAKDFVQWLMDT | 5~25 | 10~30 |
| 2 | [PLA6, D9, K12E16(Lactam), D28]G(6-29) PLA TSDYSKY1DERRAQDFVQWLMDT | 177 | 63 |
| 3 | [PLA6, D9, E16, K20E24(Lactam), D28]G(6-29) PLA TSDYSKYLDERRAEDFVKWLMDT | 239 | 74 |
| 4 | [PLA6, D9, E16, E24K28(lactam), D28]G(6-29) PLA TSDYSKYLDERRAQDFVEW1MKT | 289 | 22 |

TABLE 10-continued

| | | GLP-1 EC50 (nM) | Glucagon IC50 (nM) |
|---|---|---|---|
| 5 | [E9, E16K20(lactam), D28]G(4-29) GTFTSEYSKYLDERRAKDFVQWLMDT | 151 | 10~30 |
| 6 | [E9, E16K20(lactam), D28]G(2-29) SQGTFTSEYSKY1DERRAKDEVQWLMDT | 203 | 49 (PA) |
| 7 | [A2E3, E16K20(Lactam),D28]G(2-29) AEGTFTSEYSKYLDERRAKDFVQWLMDT | 175 | 63 |
| 8 | [A2E3, E16K20(Lactam), D28]G(1-29) HAEGTFTSEYSKY1DERRAKDFVQWLMDT | 0.2 | 130 (PA) |
| 9 | ANK2 (Bayer peptide) IISQGTFTSDY ARYLDARRAREFIKWL VRGRG | 0.28 | agonist |

TABLE 11

Glucagon (6-CEX) Analogs

| | | | GLP-1 EC50 (nM) | Glucagon IC50 |
|---|---|---|---|---|
| 1 | E9, K12, E16 | FTSEYSKY1DERRAQDEVQW1MNTGPSSGAPPPS | 1451 | 762 |
| 2 | E9, K12E16(lactam) | ETSEYSKY1DERRAQDEVQW1MNTGPSSGAPPPS | 63 | 2008 |
| 3 | E9, E16K20(lactam) | FTSEYSKY1DERRAKDEVQW1MNTGPSSGAPPPS | 36 | 42 |
| 4 | D9, K12E20(lactam) | FTSDYSKY1DERRAQDFVQW1MNTGPSSGAPPPS | 18 | 828 |
| 5 | [PLA6, E9, K12E20(lactam) | PLA-TSEYSKY1DERRAQDFVQWLMNTGPSSGAPPPS | 6 | 72 |
| 6 | [PLA6, E9, E16K20(Lactam)] | PLA-TSEYSKYLDERRAKDFVQWLMNTGPSSGAPPPS | 20 | 20 |
| 7 | PLA 6, D9, D28 | PLA-TSDYSKYLDSRRAQDFVQWLMDT | ~700 | tbd |
| 8 | PLA6, D9, K12E20(Lactam) | PLA-TSDYSKYLDERRAQDFVQWLMDT | 21 | 13 |
| 9 | PLA6, D9, E16K20(lactam) | PLA-TSDYSKYLDERRAKDFVQWLMDT | 4 | 6 |

In one embodiment, the peptide comprising the general structure A-B-C is a Class 5 peptide. In a specific embodiment, the peptide exhibits at least about 50% of the maximum agonism achieved by native GLP-1 at the GLP-1 receptor and at least about 50% inhibition of the maximum response achieved by native glucagon at the glucagon receptor. In another specific embodiment, the peptide exhibits at least about 55%, at least about 60%, at least about 70%, at least about 80%, at least about 90%, at least about 95%, or about 100% of the maximum agonism achieved by native GLP-1 at the GLP-1 receptor. Alternatively or additionally, the peptide may exhibit at least about 55%, at least about 60%, at least about 70%, at least about 80%, at least about 90%, at least about 95%, or about 100% inhibition of the maximum response achieved by native glucagon at the glucagon receptor.

In some embodiments, a peptide with Class 5 peptide or conjugate thereof, is provided comprising:
(1) modifications that confer glucagon antagonist activity, including but not limited to:
  (a) substitution of the Phe at position 6 with PLA (according to amino acid numbering of wild type glucagon), optionally with deletion of 1 to 5 amino acids from the N-terminus of wild type glucagon; or
  (b) deletion of 2 to 5 amino acids from the N-terminus of wild type glucagon; optionally with substitution of Asp at position 9 of wild type glucagon with glutamic acid, homoglutamic acid or a sulfonic acid derivative of cysteine (according to amino acid numbering of wild type glucagon);
and
(2) modifications that confer GLP-1 agonist activity, including but not limited to:
  (a) insertion or substitution of α,α-disubstituted amino acid within amino acids 12-29 of wild type glucagon, e.g. at one, two, three, four or more of positions 16, 17, 18, 19, 20, 21, 24 or 29 (according to the amino acid numbering of wild type glucagon); or
  (b) introduction of an intramolecular bridge within amino acids 12-29 of wild type glucagon, e.g. a salt bridge or a lactam bridge or another type of covalent bond; or
  (c) substitution of the amino acid at one or more of positions 2, 3, 17, 18, 21, 23, or 24 (according to the amino acid numbering of native glucagon) with the corresponding amino acid of GLP-1, e.g. Ser2 is replaced with Ala, Gln3 is replaced with Glu, Arg17 is replaced with Gln, Arg at position 18 is replaced with Ala, Asp at position 21 is replaced with Glu, Val at position 23 is replaced with Be, and/or Gln at position 24 is replaced with Ala; or (d) other modifications that stabilize the alpha-helix structure around amino acid positions 12-29 according to the amino acid numbering of wild type glucagon;

and (3) other modifications that enhance GLP-1 agonist activity, e.g.
  (a) a C-terminal amide or ester in place of a C-terminal carboxylate;

and optionally
(4) one or more of the following modifications:
  (a) covalent attachment to a hydrophilic moiety, such as polyethylene glycol, e.g. at the N-terminus, or at position 6, 16, 17, 20, 21, 24, 29, 40 or at the C-terminal amino acid; and/or
  (b) acylation or alkylation; and optionally
(5) one or more of the following additional modifications:
  (a) covalent linkage of amino acids, to the N-terminus, e.g. 1-5 amino acids to the N-terminus, optionally via an ester bond to PLA at position 6 (according to the numbering of wild type glucagon), optionally together with modifications at position 1 or 2, e.g. as described herein, that improve resistance to DPP-TV cleavage;
  (b) deletion of amino acids at positions 29 and/or 28, and optionally position 27 (according to the numbering of wild type glucagon);
  (c) covalent linkage of amino acids to the C-terminus;
  (d) non-conservative substitutions, conservative substitutions, additions or deletions while retaining desired activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;
  (e) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;
  (f) modification of the methionine at position 27, for example, by substitution with leucine or norleucine, to reduce oxidative degradation;
  (g) modification of the Gln at position 20 or 24, e.g. by substitution with Ala or AIB, to reduce degradation that occurs through deamidation of Gln
  (h) modification of Asp at position 21, e.g. by substitution with Glu, to reduce degradation that occurs through dehydration of Asp to form a cyclic succinimide intermediate followed by isomerization to iso-aspartate;
  (j) homodimerization or heterodimerization as described herein; and
  (k) combinations of the above.

It is understood that any of the modifications within the same class may be combined together and/or modifications of different classes are combined. For example, the modifications of (1)(a) may be combined with (2)(a) and (3); (1)(a) may be combined with (2)(b), e.g. lactam bridge or salt bridge, and (3); (1)(a) may be combined with (2)(c) and (3); (1)(b) may be combined with (2)(a) and (3); (1)(b) may be combined with (2)(b), e.g. lactam bridge or salt bridge, and (3); (1)(b) may be combined with (2)(c) and (3); any of the foregoing may be combined with (4)(a) and/or (4)(b); and any of the foregoing may be combined with any of (5)(a) through (5)(k).

In exemplary embodiments, the α,α-disubstituted amino acid AIB is substituted at one, two, three or all of positions 16, 20, 21, or 24 (according to the amino acid numbering of wild type glucagon).

In exemplary embodiments, the intramolecular bridge is a salt bridge.

In other exemplary embodiments, the intramolecular bridge is a covalent bond, e.g. a lactam bridge. In some embodiments, the lactam bridge is between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1001). In exemplary embodiments, acylation or alkylation is at position 6, 10, 20 or 24 or the N-terminus or C-terminus (according to the amino acid numbering of wild type glucagon) SEQ ID NO: 1001).

In exemplary embodiments, modifications include:
  (i) substitution of Asp at position 15 (according to the numbering of SEQ ID NO: 1001) with cysteic acid, glutamic acid, homoglutamic acid, and homocysteic acid;
  (ii) substitution of Ser at position 16 (according to the numbering of SEQ ID NO: 1001) with cysteic acid, glutamic acid, homoglutamic acid, and homocysteic acid;
  (iii) substitution of Asn at position 28 with a charged amino acid;
  (iv) substitution of Asn at position 28 with a charged amino acid selected from the group consisting of Lys, Arg, His, Asp, Glu, cysteic acid, and homocysteic acid;
  (v) substitution at position 28 with Asn, Asp, or Glu;
  (vi) substitution at position 28 with Asp;
  (vii) substitution at position 28 with Glu;
  (viii) substitution of Thr at position 29 with a charged amino acid;
  (ix) substitution of Thr at position 29 with a charged amino acid selected from the group consisting of Lys, Arg, His, Asp, Glu, cysteic acid, and homocysteic acid;
  (x) substitution at position 29 with Asp, Glu, or Lys;
  (xi) substitution at position 29 with Glu;
  (xii) insertion of 1-3 charged amino acids after position 29;
  (xiii) insertion after position 29 of Glu or Lys;
  (xiv) insertion after position 29 of Gly-Lys or Lys-Lys;
  or combinations thereof.

Any of the modifications described above which increase GLP-1 receptor agonist activity, glucagon receptor antagonist activity, peptide solubility, and/or peptide stability can be applied individually or in combination.

Modification to Enhance Stability

In accordance with one embodiment the Class 5 peptides disclosed herein can be further modified to include the amino acid sequence of SEQ ID NO: 1021 (GPSSGAPPPS), or SEQ ID NO: 1050, linked to the carboxy terminal amino acid (position 24) of the Class 5 peptide and administered to individuals to induce weight loss or assist in weight maintenance. More particularly, the Class 5 peptide comprises a sequence selected from the group consisting of SEQ ID NO: 1005, SEQ ID NO: 1006, SEQ ID NO: 1007, SEQ ID NO: 1008, SEQ ID NO: 1009, SEQ ID NO: 1012, SEQ ID NO: 1013, SEQ ID NO: 1014, SEQ ID NO: 1016, SEQ ID NO: 1017, SEQ ID NO: 1018, SEQ ID NO: 1019, SEQ ID NO: 1022, SEQ ID NO: 1023, SEQ ID NO: 1024 and SEQ ID NO: 1025 and further comprising the amino acid sequence of SEQ ID NO: 1021 (GPSSGAPPPS), or SEQ ID NO: 1050, linked to the carboxy terminal amino acid (position 24) of the peptide or Class 5 peptide, is used to suppress appetite and inducing weight loss/weight maintenance. In one embodiment the administered peptide or Class 5 peptide comprises a sequence selected from the group consisting of SEQ ID NO: 1016, SEQ ID NO: 1017, SEQ ID NO: 1018 and SEQ ID NO: 1019, further comprising the amino acid sequence of SEQ ID NO: 1021 (GPSSGAPPPS) linked to the carboxy terminal amino acid (position 24) of the Class 5 peptide. In one embodiment the method comprises administering a peptide or Class 5 peptide comprising the sequence of SEQ ID NO: 1045 or SEQ ID NO: 1046.

Accordingly, it is expected that the Class 5 peptides disclosed herein can be similarly modified to decrease their susceptibility to premature chemical cleavage in aqueous buffers. In accordance with one embodiment the Class 5 peptides described herein can be further modified to enhance their stability in aqueous solutions by replacing the native aspartic amino acid, located at corresponding position 15 of native glucagon, with an amino acid selected from the group consisting of cysteic acid, glutamic acid, homoglutamic acid and homocysteic acid. In accordance with one embodiment the aspartic acid residue at position 10 of class 5 peptide of SEQ ID NO: 1005, SEQ ID NO: 1006, SEQ ID NO: 1007 or SEQ ID NO: 1008 can be substituted with an amino acid selected from the group consisting of cysteic acid, glutamic acid, homoglutamic acid and homocysteic acid, and in one embodiment the native aspartic acid at position 10 of SEQ ID NO: 1005, SEQ ID NO: 1006, SEQ ID NO: 1007 or SEQ ID NO: 1008 is replaced with glutamic acid. In accordance with one embodiment a class 5 peptide having improved stability in aqueous solutions is provided wherein the antagonist comprises a modified sequence of SEQ ID NO: 1009, wherein the modification comprises substitution of the Asp at position 10 of SEQ ID NO: 1009 with Glu. In one embodiment a class 5 peptide is provided comprising a sequence selected form the group consisting of SEQ ID NO: 1022, SEQ ID NO: 1023, SEQ ID NO: 1024 and SEQ ID NO: 1025. In one embodiment the class 5 peptide is amidated.

The Asp-Ser sequence at position 15-16 of native glucagon has been identified as a uniquely unstable dipeptide that leads to premature chemical cleavage of the native hormone in aqueous buffers. For example, when maintained at 0.01N HCl at 37° C. for 2 weeks, more than 50% of the native glucagon may be cleaved into fragments. The two liberated cleavage peptides 1-15 and 16-29 are devoid of glucagon-like biological activity and thus represent a limitation on the aqueous pre-formulation of glucagon and its related analogs. The selective chemical substitution of the Asp at position 15 of native glucagon with Glu has been observed to virtually eliminate chemical cleavage of the 15-16 peptide bond.

In yet further exemplary embodiments, any of the foregoing compounds can be further modified to improve stability by modifying the amino acid corresponding to position 15 or 16 of native glucagon, to reduce degradation of the peptide over time, especially in acidic or alkaline buffers.

Modification to Enhance Solubility

The class 5 peptide can be further modified to improve the peptide's solubility in aqueous solutions at physiological pH, in certain aspects, while retaining the glucagon antagonist and GLP-1 agonist activity. Introduction of hydrophilic groups at positions corresponding to positions 12, 15, 16, 19 and 24 of the peptide of SEQ ID NO: 1005, or at positions 12, 16, 19 or 24 of the peptide of SEQ ID NO: 1006 can improve the solubility of the resulting peptides in solutions having a physiological pH, while retaining the parent compounds glucagon antagonist and GLP agonist activity. Therefore, in one embodiment the presently disclosed class 5 peptide that are further modified to comprise one or more hydrophilic groups covalently linked to the side chains of amino acids corresponding to amino acid positions 12, 15, 16, 19 and 24 of the peptide of SEQ ID NO: 1005 or SEQ ID NO: 1006. In a further embodiment the side chains of amino acids corresponding to amino acid positions 16 and 19 of SEQ ID NO: 1005 or SEQ ID NO: 1006 are covalently bound to hydrophilic groups, and in one embodiment the hydrophilic group is polyethylene glycol (PEG).

Class 5 glucagon related analog peptides can be modified by introducing charge at its carboxy terminus to enhance the solubility of the peptide while retaining the agonist properties of the peptide. The enhanced solubility allows for the preparation and storage of glucagon solutions at near neutral pH. Formulating glucagon solutions at relatively neutral pHs (e.g. pH of about 6.0 to about 8.0) improves the long term stability of the Class 5 peptides.

Applicants anticipate that class 5 peptides disclosed herein can be similarly modified to enhance their solubility in aqueous solutions at relatively neutral pH (e.g. pH of about 6.0 to about 8.0), in some cases, while retaining a glucagon antagonist and GLP-1 activity. Accordingly, one embodiment is directed to a glucagon antagonist/GLP-1 of SEQ ID NO: 1005, SEQ ID NO: 1006, SEQ ID NO: 1007 or SEQ ID NO: 1008 that has been further modified relative to the native amino acids present at positions 6-29 of the wild type glucagon (SEQ ID NO: 1001) to add charge to the peptide by the substitution of native non-charged amino acids with charged amino acids, or the addition of charged amino acids to the carboxy terminus. In accordance with one embodiment, one to three of the non-charged native amino acids of the class 5 peptides disclosed herein are replaced with a charged amino acid. In one embodiment the charged amino acid is selected from the group consisting of lysine, arginine, histidine, aspartic acid and glutamic acid. More particularly, applicants have discovered that substituting the normally occurring amino acid corresponding to position 28 and/or 29 (relative to native glucagon) with charged amino acids, and/or the addition of one to two charged amino acids at the carboxy terminus of the peptide, enhances the solubility and stability of the Class 5 peptide in aqueous solutions at physiologically relevant pHs (i.e., a pH of about 6.5 to about 7.5). Accordingly such modifications of class 5 peptides are anticipated to have a similar effect on the solubility in aqueous solutions, particularly at a pH ranging from about 5.5 to about 8.0, while retaining the parent peptide's biological activity In accordance with one embodiment the class 5 peptide of SEQ ID NO: 1005, SEQ ID NO: 1006, SEQ ID NO: 1007 or SEQ ID NO: 1008 is modified by the substitution of the native amino acid at position 23 and/or 24 of those sequences with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment a class 5 peptide comprising SEQ ID NO: 1005, SEQ ID NO: 1006, SEQ ID NO: 1007 or SEQ ID NO: 1008 is modified by the substitution of the native amino acid at position 24 of SEQ ID NO: 1005, SEQ ID NO: 1006, SEQ ID NO: 1007 or SEQ ID NO: 1008 with a positively charged amino acid (e.g., lysine, arginine or histidine) and optionally the addition of one or two positively charged amino acid (e.g., lysine, arginine or histidine) on the carboxy terminus of the peptide. In accordance with one embodiment a class 5 peptide having improved solubility and stability is provided wherein the analog comprises the amino acid sequence of SEQ ID NO: 1015 or SEQ ID NO: 1051 with the proviso that at least one amino acids at position, 23, or 24 of SEQ ID NO: 1015 or SEQ ID NO: 1051 is substituted with an acidic amino acid and/or an additional acidic amino acid added at the carboxy terminus of SEQ ID NO: 1015 or SEQ ID NO: 1051. In one embodiment the acidic amino acids are independently selected from the group consisting of Asp, Glu, cysteic acid and homocysteic acid.

In accordance with one embodiment a class 5 peptide having improved solubility and stability is provided wherein the antagonist comprises the amino acid sequence of SEQ ID NO: 1016, SEQ ID NO: 1017, SEQ ID NO: 1018 or SEQ ID NO: 1019. In accordance with one embodiment a glucagon agonist is provided comprising the sequence of SEQ ID NO: 1016 or SEQ ID NO: 1017. In one embodiment the class 5 peptide comprises the sequence of SEQ ID NO: 1020.

In accordance with one embodiment a class 5 peptide is provided comprising the sequence of SEQ ID NO: 1015 or SEQ ID NO: 1051. In one embodiment, position 4 of SEQ ID NO: 1015 or SEQ ID NO: 1051 is aspartic acid, glutamic acid, homoglutamic acid, cysteic acid or homocysteic acid, and in one embodiment position 4 is aspartic acid, glutamic acid, cysteic acid or homocysteic acid, and in a further embodiment position 4 of SEQ ID NO: 1015 or SEQ ID NO: 1051 is aspartic acid or glutamic acid, and in one embodiment position 4 of SEQ ID NO: 1015 or SEQ ID NO: 1051 is aspartic acid. In one embodiment a class 5 peptide is provided comprising the sequence of SEQ ID NO: 1015 or SEQ ID NO: 1051 wherein position 4 of SEQ ID NO: 1015 is aspartic acid and position 10 of SEQ ID NO: 1015 is glutamic acid. In a further embodiment the C-terminal amino acid of SEQ ID NO: 1015 or SEQ ID NO: 1051 is modified to replace the native carboxylic acid group with a charge-neutral group, such as an amide or ester.

Class 5 Peptide Fusions

In a further embodiment, the carboxy terminal amino acid of the Class 5 peptide described herein is covalently bound to a second peptide comprising a sequence selected from the group consisting of SEQ ID NOs: 1021, 1026, 1027, and 1050. For example, in one embodiment, the Class 5 peptide of SEQ ID NO: 1015, SEQ ID NO: 1051, SEQ ID NO: 1005, SEQ ID NO: 1006, SEQ ID NO: 1007, SEQ ID NO: 1008, SEQ ID NO: 1012, SEQ ID NO: 1013, SEQ ID NO: 1014, SEQ ID NO: 1016, SEQ ID NO: 1017, SEQ ID NO: 1018, SEQ ID NO: 1019, SEQ ID NO: 1022, SEQ ID NO: 1023, SEQ ID NO: 1024 and SEQ ID NO: 1025 is covalently bound to a second peptide comprising a sequence selected from the group consisting of SEQ ID NO: 1021 (GPSSGAPPPS), SEQ ID NO: 1026 (KRNRNNIA), SEQ ID NO: 1027 (KRNR) and SEQ ID NO: 1050 (GPSSGAPPPSX).

In one embodiment a class 5 peptide dimer is provided comprising two sequences independently selected from the group consisting of SEQ ID NO: 1005, SEQ ID NO: 1006, SEQ ID NO: 1007, SEQ ID NO: 1008, SEQ ID NO: 1009, SEQ ID NO: 1022, SEQ ID NO: 1023, SEQ ID NO: 1024 and SEQ ID NO: 1025 that further comprises an amino acid sequence of SEQ ID NO: 1021 (GPSSGAPPPS) linked to the carboxy terminal amino acid of the class 5 peptide.

In some embodiments, the class 5 peptide is further modified by truncation or deletion of one or two amino acids of the C-terminus of the peptide (i.e., truncation of the amino acid at position 29 or at positions 28 and 29 of native glucagon). Preferably truncation does not effect activity (e.g., glucagon antagonism/GLP-1 agonism) of a class 5 peptide.

Class 5 Peptide Conjugates

Conjugates of Class 5 peptides are also provided, in which the glucagon peptide is linked, optionally via covalent bonding and optionally via a linker, to a conjugate moiety.

In those embodiments wherein the class 5 peptide comprises a polyethylene glycol chain, the polyethylene chain may be in the form of a straight chain or it may be branched. In accordance with one embodiment the polyethylene glycol chain has an average molecular weight selected from the range of about 500 to about 10,000 Daltons. In one embodiment the polyethylene glycol chain has an average molecular weight selected from the range of about 1,000 to about 5,000 Daltons. In one embodiment the polyethylene glycol chain has an average molecular weight selected from the range of about 1,000 to about 5,000 Daltons. In one embodiment the polyethylene glycol chain has an average molecular weight selected of about 1,000 to about 2,000 Daltons. In one embodiment the polyethylene glycol chain has an average molecular weight of about 1,000 Daltons.

In one embodiment the pegylated class 5 peptide comprises a peptide consisting of the sequence of SEQ ID NO: 1015 or SEQ ID NO: 1051 wherein the polyethylene glycol chain is linked to an amino acid selected from positions 11, 12, 15, 16, 19 and 24 of SEQ ID NO: 1015 or SEQ ID NO: 1051, and the molecular weight of the PEG chain is about 1,000 to about 5,000 Daltons. In one embodiment the pegylated class 5 peptide comprises a peptide consisting of the sequence of SEQ ID NO: 1015 or SEQ ID NO: 1051 wherein the polyethylene glycol chain is linked to the amino acid at position 16 or 19 of SEQ ID NO: 1015 or SEQ ID NO: 1051, and the molecular weight of the PEG chain is about 1,000 to about 5,000 Daltons. In a further embodiment the modified class 5 peptide comprises two or more polyethylene chains covalently bound to the peptide wherein the total molecular weight of the glucagon chains is about 1,000 to about 5,000 Daltons. In one embodiment the class 5 peptide comprises the sequence of SEQ ID NO: 1015 or SEQ ID NO: 1051 wherein a polyethylene glycol chain is linked to the amino acid at positions 16 and 19 of SEQ ID NO: 1015 or SEQ ID NO: 1051 and the combined molecular weight of the two PEG chains is about 1,000 to about 5,000 Daltons.

The class 5 glucagon related analog peptide may comprise the amino acid sequence of any of the amino acid sequences of SEQ ID NOs: 1001-1118, optionally with up to 1, 2, 3, 4, or 5 further modifications that retain glucagon antagonist and GLP-1 agonist activity.

Position of the Dipeptide Relative to the Bioactive Peptide, Polypeptide, or Protein The prodrug dipeptide is covalently attached via an ester bond to any amino acid of the bioactive peptide, polypeptide, or protein. In some embodiments, the dipeptide is attached to an amino acid or hydroxyl acid which is part of the active site of the bioactive peptide, polypeptide, or protein.

In some embodiments, the dipeptide is attached to the bioactive peptide, polypeptide, or protein via an ester bond between the dipeptide and the first amino acid of the bioactive peptide, polypeptide, or protein. In some aspects, the dipeptide is attached to the side chain of the first amino acid of the bioactive peptide, polypeptide, or protein, whereas in other aspects, the dipeptide is attached to the alpha carbon of the first amino acid of the bioactive peptide, polypeptide, or protein via an ester bond. In the latter instance, the first amino acid of the bioactive peptide, polypeptide, or protein is an HO-amino acid. In more specific aspects, the first amino acid of the bioactive peptide, polypeptide, or protein is HO-His, HO-Tyr, HO-Phe, or a derivative of HO-Phe.

In other embodiments, the dipeptide is attached to the bioactive peptide, polypeptide, or protein via an ester bond between the dipeptide and the last amino acid of the bioactive peptide, polypeptide, or protein. In some aspects, the dipeptide is attached to the side chain of the last amino acid of the bioactive peptide, polypeptide, or protein, whereas in other aspects, the dipeptide is attached to the alpha carbon of the last amino acid of the bioactive peptide, polypeptide, or protein via an ester bond. In the latter instance, the last amino acid of the bioactive peptide, polypeptide, or protein is an amino alcohol in which the native alpha carboxylate group has been changed to an alcohol group.

In alternative embodiments, the dipeptide is attached to an internal amino acid residue of the bioactive peptide, polypeptide, or protein. In some embodiments, the internal amino acid is an amino acid comprising a side chain hydroxyl group, e.g., Ser, Thr.

In some embodiments, in which the bioactive peptide, polypeptide, or protein is glucagon, the dipeptide is attached to position 2, 5, 7, 8, or 11 of glucagon (SEQ ID NO: 612). In other embodiments, in which the bioactive peptide, polypeptide, or protein is a glucagon superfamily peptide (e.g., glucagon related analog peptide), the dipeptide is attached to the position of the glucagon superfamily peptide which corresponds to position 2, 5, 7, 8, or 11 of glucagon (SEQ ID NO: 612). The position of the glucagon superfamily peptide which corresponds to position 2, 5, 7, 8, or 11 of glucagon can be determined by aligning the amino acid sequence the glucagon superfamily peptide with the amino acid sequence of native glucagon. For example, a number of glucagon superfamily peptide sequences are aligned with the glucagon sequence (SEQ ID NO: 612) in FIG. 18.

In some embodiments, in which the bioactive peptide is insulin, the dipeptide is attached to position 4 or 21 of the A chain of insulin or to position 5 or 9 of the B chain of insulin. In another embodiment, wherein the bioactive peptide is insulin, the dipeptide is attached to the N- or C-terminal amino acid of the A or B chain of insulin. In a more specific embodiment, wherein the insulin comprises SEQ ID NO: 626 and/or SEQ ID NO: 628, the dipeptide is attached to the amino acid at position 1, 4, or 21 or SEQ ID NO: 626 or to the amino acid at position 1, 5, 12, or 21 of SEQ ID NO: 628.

Regarding other bioactive peptides, polypeptides, and proteins, the position at which the dipeptide should be attached can be determined by testing the activity level of a prodrug form of the bioactive peptide, polypeptide, or protein comprising a dipeptide attached via an ester bond to a Ser or Thr residue which is present in the native amino acid sequence of the bioactive peptide, polypeptide, or protein. If the activity level of the modified bioactive peptide, polypeptide, or protein is less than about 10% (e.g., less than about 5%, less than about 1%) of the activity level of the corresponding bioactive peptide, polypeptide, or protein, which does not comprise the dipeptide, then the Ser or Thr to which the dipeptide is attached is identified as a good position for attachment of the dipeptide.

Alternatively, the bioactive peptide, polypeptide, or protein can be modified to replace a native amino acid with a Ser or Thr and the modified bioactive peptide, polypeptide, or protein can be tested for activity. If the modified bioactive peptide, polypeptide, or protein demonstrates activity that is similar, the same as, or higher than the activity of the unmodified bioactive peptide, polypeptide, or protein, then the modified bioactive peptide, polypeptide, or protein can then be tested for activity as a prodrug comprising a dipeptide moiety attached to the Ser or Thr which replaced the native amino acid. If the activity level of the prodrug of the modified bioactive peptide, polypeptide, or protein is less than about 10% (e.g., less than about 5%, less than about 1%) of the activity level of the modified bioactive peptide, polypeptide, or protein, which does not comprise the dipeptide, then the Ser or Thr to which the dipeptide is attached is identified as a good position for attachment of the dipeptide.

Prodrug Dipeptide Moieties

The dipeptide of the prodrugs described herein is any combination of two covalently linked amino acids or covalently linked hydroxyl acid and amino acid which is capable of forming a diketopiperidine (DKP) or a diketomorpholine (DMP) in PBS under physiological conditions (e.g., in the absence of any enzymes or additional chemicals). The formation of the DKP or DMP results in cleavage of the ester bond between the dipeptide and the bioactive peptide, polypeptide, or protein. The structure of the dipeptide governs the tendency for DKP or DMP formation, and thus governs the rate of cleavage of the dipeptide from the bioactive peptide, polypeptide, or protein. In some embodiments, the dipeptide comprises the structure A-B, wherein A is a hydroxyl acid or amino acid covalently linked to B, and B is an amino acid which is attached to the bioactive peptide, polypeptide, or protein via an ester bond.

In some embodiments, each of A and B is the L-stereoisomer of an amino acid or hydroxyl acid, in which case the DKP or DMP formation occurs slower than when the dipeptide comprises an L-stereoisomer and a D-stereoisomer.

In some embodiments, each of A and B comprises side chains that are sterically hindered or bulky, such as, for example, (i) branched side chains comprising the structure of Formula VII

Formula VII wherein each of X and Y is independently selected from the group consisting of C, O, S, or N, and $R_{15}$ and $R_{16}$ are independently selected from the group consisting of H, $C_1$-$C_{18}$ alkyl, ($C_2$-$C_{18}$ alkyl)OH, ($C_2$-$C_{18}$ alkyl)SH, ($C_2$-$C_3$ alkyl)SCH$_3$, ($C_1$-$C_4$ alkyl)CONH$_2$, ($C_2$-$C_4$ alkyl)COOH, ($C_2$-$C_4$ alkyl)NH$_2$, ($C_2$-$C_4$ alkyl)NHC(NH$_2^+$) NH$_2$, ($C_4$-$C_6$)cycloalkyl, ($C_0$-$C_4$ alkyl)($C_6$-$C_{10}$ aryl)$R_{17}$, and CH$_2$($C_5$-$C_9$ heteroaryl), wherein $R_{17}$=H, $C_1$-$C_4$ alkyl, NH$_2$ or OH;

and (ii) side chains of aromatic amino acids (e.g., Tyr, Phe, Trp). The presence of such side chains reduces the rate of cleavage from the bioactive peptide and the rate of DKP or DMP formation.

In other embodiments, neither A nor B comprise side chains that are sterically hindered or bulky. The absence of such side chains reduces the rate of cleavage from the bioactive peptide and the rate of DKP or DMP formation.

In yet other embodiments, one of A or B comprises a sterically hindered or bulky side chain, which provides an intermediate rate of cleavage and rate of DKP or DMP formation. Specific dipeptide moieties of the prodrugs described herein include, but are not limited to, any of the dipeptides shown herein at Tables 4 and 5 and below under Exemplary Prodrug Embodiments.

Exemplary Prodrug Embodiments

In accordance with some embodiments, the prodrug comprises a general structure of A-B-Q, wherein A is a hydroxyl acid or amino acid covalently linked to B; B is an amino acid covalently linked to Q via an ester bond, and Q is a bioactive peptide, polypeptide, or protein, e.g., a glucagon superfamily peptide (e.g., a glucagon related analog peptide), wherein the chemical cleavage half-life ($t_{1/2}$) of A-B from Q is no more than about 1 week in PBS under physiological conditions.

A-B is cleaved from Q in a manner that is independent of any enzymes. Accordingly, the $t_{1/2}$ of A-B from Q in PBS under physiological conditions is not significantly different from the $t_{1/2}$ of A-B from Q in a solution comprising a DPP-IV protease under physiological conditions. The solution comprising a DPP-IV protease can be, for example, serum. In some embodiments, the $t_{1/2}$ of A-B from Q in PBS under physiological conditions is not more than two fold the $t_{1/2}$ of A-B from Q in a solution comprising a DPP-IV protease under physiological conditions.

The $t_{1/2}$ of A-B from Q in PBS under physiological conditions in some embodiments is about 24 hours or less, e.g., about 1 to about 2 hours, about 5 hours or less, about 8 hours or less, about 12 hours or less, about 16 hours or less, about 20 hours or less.

In some embodiments, the $t_{1/2}$ of A-B from Q in PBS under physiological conditions is less than about 1.5 hours. In these instances, neither the side chain of A nor the side chain of B comprises the structure of Formula VII:

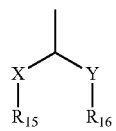

Formula VII wherein each of X and Y is independently selected from the group consisting of C, O, S, or N, and $R_{15}$ and $R_{16}$ are independently selected from the group consisting of H, $C_1$-$C_{18}$ alkyl, ($C_2$-$C_{18}$ alkyl)OH, ($C_2$-$C_{18}$ alkyl)SH, ($C_2$-$C_3$ alkyl) $SCH_3$, ($C_1$-$C_4$ alkyl)$CONH_2$, ($C_2$-$C_4$ alkyl)COOH, ($C_2$-$C_4$ alkyl)$NH_2$, ($C_2$-$C_4$ alkyl)NHC($NH_2^+$) $NH_2$, ($C_4$-$C_6$)cycloalkyl, ($C_0$-$C_4$ alkyl)($C_6$-$C_{10}$ aryl)$R_{17}$, and $CH_2$($C_5$-$C_9$ heteroaryl), wherein $R_{17}$=H, $C_1$-$C_4$ alkyl, $NH_2$ or OH;

B optionally is an aromatic amino acid; and

A or B optionally is a disubstituted amino acid, e.g., AIB.

In some embodiments, wherein the $t_{1/2}$ of A-B from Q in PBS under physiological conditions is less than about 1.5 hours, A is selected from the group consisting of Gly, Ala, Ser, Thr, Glu, Asp, Gln, Asn, Met, His, Cys, Lys, Pro, Arg, a di substituted amino acid (e.g., AIB), or a hydroxyl acid or a D-stereoisomer of any of the foregoing;

and B is selected from the group consisting of Gly, Ala, Ser, Thr, Glu, Asp, Gln, Asn, Met, His, Cys, Lys, Pro, Arg, a disubstituted amino acid (e.g., AIB), Trp, Tyr, Phe, or a D-stereoisomer of any of the foregoing.

In some embodiments, each of A and B comprises a side chain of structure

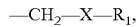

wherein X is C, O, S, or N, wherein $R_1$ is H, $C_1$-$C_{18}$ alkyl, ($C_2$-$C_{18}$ alkyl)OH, ($C_2$-$C_{18}$ alkyl)SH, ($C_2$-$C_3$ alkyl)$SCH_3$, ($C_1$-$C_4$ alkyl)$CONH_2$, ($C_2$-$C_4$ alkyl)COOH, ($C_2$-$C_4$ alkyl) $NH_2$, ($C_2$-$C_4$ alkyl)NHC($NH_2^+$) $NH_2$, ($C_4$-$C_6$)cycloalkyl, ($C_0$-$C_4$ alkyl)($C_6$-$C_{10}$ aryl)$R_9$, and $CH_2$($C_5$-$C_9$ heteroaryl), wherein $R_9$=$C_1$-$C_4$ alkyl, $NH_2$ or OH, In yet other embodiments, one or both of A and B are disubstituted amino acids comprising a side chain (e.g., as described above) and a second substitution with a $C_1$-$C_{18}$ alkyl.

In other embodiments, the $t_{1/2}$ of A-B from Q is between about 1.5 hours and about 24 hours. In such cases, (i) only one of A and B comprises a branched side chain of Formula VII

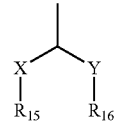

Formula VII wherein each of X and Y is independently selected from the group consisting of C, O, S, or N, and $R_{15}$ and $R_{16}$ are independently selected from the group consisting of H, $C_1$-$C_{18}$ alkyl, ($C_2$-$C_{18}$ alkyl)OH, ($C_2$-$C_{18}$ alkyl)SH, ($C_2$-$C_3$ alkyl) $SCH_3$, ($C_1$-$C_4$ alkyl)$CONH_2$, ($C_2$-$C_4$ alkyl)COOH, ($C_2$-$C_4$ alkyl)$NH_2$, ($C_2$-$C_4$ alkyl)NHC($NH_2^+$) $NH_2$, ($C_4$-$C_6$)cycloalkyl, ($C_0$-$C_4$ alkyl)($C_6$-$C_{10}$ aryl)$R_{17}$, and $CH_2$($C_5$-$C_9$ heteroaryl), wherein $R_{17}$=H, $C_1$-$C_4$ alkyl, $NH_2$ or OH; and the other of A and B is not an aromatic amino acid; (ii) only A is an aromatic amino acid, or (iii) each of A and B is an aromatic amino acid and one is a D-amino acid and the other is an L-amino acid. In specific embodiments, B comprises the branched side chain.

In yet other embodiments, the $t_{1/2}$ of A-B from Q in PBS under physiological conditions is less than 1 week but greater than about 24 hours, e.g., greater than about 36 hours, greater than about 48 hours, greater than about 72 hours, greater than about 96 hours, greater than about 120 hours, greater than about 150 hours. In such cases, each of A and B independently is an aromatic amino acid or comprises a branched side chain of Formula VII

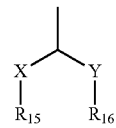

Formula VII wherein X is C, O, S, or N, and $R_{15}$ and $R_{16}$ are independently selected from the group consisting of H, $C_1$-$C_{18}$ alkyl, ($C_2$-$C_{18}$ alkyl)OH, ($C_2$-$C_{18}$ alkyl)SH, ($C_2$-$C_3$ alkyl)$SCH_3$, ($C_1$-$C_4$ alkyl)$CONH_2$, ($C_2$-$C_4$ alkyl)COOH, ($C_2$-$C_4$ alkyl)$NH_2$, ($C_2$-$C_4$ alkyl)NHC($NH_2^+$) $NH_2$, ($C_4$-$C_6$)cycloalkyl, ($C_0$-$C_4$ alkyl)($C_6$-$C_{10}$ aryl)$R_{17}$, and $CH_2$($C_5$-$C_9$ heteroaryl), wherein $R_{17}$=H, $C_1$-$C_4$ alkyl, $NH_2$ or OH; wherein, when both A and B are aromatic amino acids, both are L-amino acids.

In some embodiments, A-B is attached to Q via an ester bond between B and the first amino acid of Q. In some aspects, A-B is attached to the side chain of the first amino acid of Q, whereas in other aspects, A-B is attached to the alpha carbon of the first amino acid of Q via an ester bond. In the latter instance, the first amino acid of Q is an HO-amino acid. In more specific aspects, the first amino acid of Q is HO-His, HO-Tyr, HO-Phe, or a derivative of HO-Phe.

In other embodiments, A-B is attached to Q via an ester bond between B and the last amino acid of Q. In some aspects, A-B is attached to the side chain of the last amino acid of Q, whereas in other aspects, A-B is attached to alpha carbon of the last amino acid of Q via an ester bond. In the latter instance, the last amino acid of Q is an amino alcohol in which the native alpha carboxylate group has been changed to an alcohol group.

In yet other embodiments, wherein A-B is attached to Q via an ester bond between B and an internal amino acid of Q. In more specific aspects, the internal amino acid of Q is located at position 2, 5, 7, 8, or 11 (according to the amino acid numbering of native glucagon (SEQ ID NO: 612). In some aspects, the internal amino acid of Q is an amino acid comprising a side chain comprising a hydroxyl group (e.g., Ser, Thr).

In one embodiment an injectable depot composition is provided comprising a complex having the general structure of A-B-Q wherein A is an amino acid or a hydroxyl acid;

B is an amino acid covalently linked to Q via an ester bond, and Q is a bioactive peptide, polypeptide, or protein, e.g., a glucagon superfamily peptide such as a glucagon related analog peptide, wherein the dipeptide A-B further comprises a depot polymer linked to A or B. The dipeptide A-B may comprise any of the structures previously described in the present application, that provide a desired non-enzymatic self cleavage half life from Q, wherein the dipeptide structure is further modified by linkage to a depot polymer. The depot polymer is selected to be of sufficient size that the complex A-B-Q is effectively sequestered at the site of injection or is otherwise incapable of interacting with its target (e.g., its receptor). In one embodiment the depot polymer is linked to the side chain of A and/or B. Suitable depot polymers for use in this embodiment include, for example, any of the polymers disclosed in reference to the compound of Formula XI as provided on pages 164-166 of the present specification, as well as other biocompatible polymers known to those skilled in the art.

Chemical cleavage of A-B from Q produces a diketopiperazine or diketomorpholine and releases the active bioactive peptide, polypeptide, or protein to the patient in a controlled manner over a predetermined duration of time after administration. In accordance with one embodiment an aliphatic hydroxyl group of the bioactive peptide or protein (Q), including for example the hydroxyl bearing side chain of a serine or threonine residue or the hydroxyl group of an N-terminal hydroxylated amino acid (HO-amino acid), is modified by the covalent linkage of the dipeptide (A B):

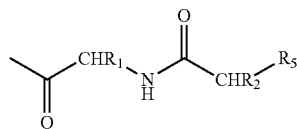

to the bioactive polypeptide via an ester linkage, wherein $R_1$ and $R_2$ are independently selected from the group consisting of H, $C_1$-$C_6$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$) NH$_2$, ($C_4$-$C_6$) cycloalkyl, ($C_0$-$C_4$ alkyl)($C_6$-$C_{10}$ aryl)$R_{17}$, and CH$_2$($C_5$-$C_9$ heteroaryl), wherein $R_{17}$ is H, $C_1$-$C_4$ alkyl, NH$_2$ or OH and $R_5$ is OH or NH$_2$, wherein the dipeptide (A-B) is further modified to comprises a depot polymer covalently linked to the dipeptide. The depot polymer comprising dipeptide can be linked to the bioactive peptide or protein through any aliphatic hydroxyl group of the bioactive peptide or protein, including for example the hydroxyl bearing side chain of a serine or threonine residue or the hydroxyl group of an hydroxyl acid located at the terminus of the peptide. In one embodiment $R_1$ and $R_2$ are independently selected from the group consisting of H, $C_1$-$C_{18}$ alkyl, ($C_2$-$C_{18}$ alkyl)OH, ($C_2$-$C_{18}$alkyl)SH, ($C_2$-$C_3$ alkyl)SCH$_3$, ($C_1$-$C_4$ alkyl)CONH$_2$, alkyl)COOH, ($C_2$-$C_4$ alkyl)NH$_2$, ($C_2$-$C_4$ alkyl)NHC(NH$_2^+$) NH$_2$, ($C_4$-$C_6$)cycloalkyl, ($C_0$-$C_4$ alkyl)($C_6$-$C_{10}$ aryl)$R_{17}$, and CH$_2$($C_5$-$C_9$ heteroaryl), wherein $R_{17}$=H, $C_1$-$C_4$ alkyl, NH$_2$ or OH, and the depot polymer is covalently linked through one of the $R_1$ and/or $R_2$ substituents. In one embodiment the bioactive peptide, polypeptide, or protein is a glucagon superfamily peptide or a glucagon related analog peptide. In one embodiment two or more depot polymers are linked to a single dipeptide element.

The depot polymer is selected to be biocompatible and of sufficient size that the bioactive peptide, polypeptide, or protein modified by covalent attachment of the dipeptide/depot polymer complex remains sequestered at an injection site and/or is incapable of interacting with its corresponding receptor upon administration to a patient. Subsequent cleavage of the dipeptide releases the bioactive peptide to interact with its intended target. Selection of different combinations of substituents on the dipeptide element will allow for the preparation of injectable compositions that comprise a mixture of dipeptide/bioactive peptide complexes that individually release the bioactive peptide over a desired time frame. In one embodiment one or more depot polymers are covalently linked to A and/or B either directly or indirectly through a linker. In one embodiment one or more depot polymers are non-covalently linked through a high affinity association with A or B (either through direct interaction with A or B or through a linking moiety covalently bound to A or B). For example in one embodiment the depot polymer is indirectly linked to the side chain of A or B via linkage to a covalently bound C16 or C18 acyl or alkyl group. Chemical cleavage of A-B from Q produces a diketopiperazine or diketomorpholine and releases the active bioactive peptide, in a controlled manner over a predetermined duration of time after administration, to distribute systemically in the patient (in those embodiment where the initial complex is initially sequestered) and allows the active bioactive peptide to interact with its target ligand.

In one embodiment an injectable composition is provided wherein the composition comprises a plurality of different dipeptide/bioactive peptide complexes wherein the dipeptide/bioactive peptide complexes differ from each other based on the structure of the dipeptide moiety. In accordance with one embodiment the dipeptide/bioactive peptide complexes comprise a compound of the general structure of A-B-Q (as defined immediately above) with a depot polymer linked to A or B, wherein the dipeptide/bioactive peptide complexes differ from one another based on the substituents of A and/or B. In this manner an injectable composition can be provided wherein the bioactive peptide, polypeptide, or protein (Q) is released in a controlled manner over an extended period of time based on the cleavage rates of the individual different complexes. In accordance with one embodiment a composition is provided wherein the composition comprises a mixture of the bioactive peptide, polypeptide, or protein (Q) in a free form as well as the bioactive peptide, polypeptide, or protein (Q) covalently bound to the dipeptide element. In this manner the administered composition will have an immediate therapeutic effect due to the presence of the active bioactive peptide, polypeptide, or protein in free form. In addition, there will be an extended or delayed biological effect as the dipeptide is cleaved from the A-B-Q complex and releases additional active bioactive peptide, polypeptide, or protein (Q) at a predetermined time interval after the initial administration of the composition.

In accordance with one embodiment the depot polymer is selected from biocompatible polymers known to those skilled in the art. The depot polymers typically have a size selected from a range of about 20,000 to 120,000 Daltons. In one embodiment the depot polymer has a size selected from a range of about 40,000 to 100,000 or about 40,000 to 80,000 Daltons. In one embodiment the depot polymer has a size of about 40,000, 50,000, 60,000, 70,000 or 80,000 Daltons. Suitable depot polymers include but are not limited to dextrans, polylactides, polyglycolides, caprolactone-based polymers, poly(caprolactone), polyanhydrides, polyamines, polyesteramides, polyorthoesters, polydioxanones, polyacetals, polyketals, polycarbonates, polyphosphoesters, polyesters, polybutylene terephthalate, polyorthocarbonates, polyphosphazenes, succinates, poly(malic acid), poly(amino acids), polyvinylpyrrolidone, polyethylene glycol, polyhydroxycellulose, polysaccharides, chitin, chitosan, hyaluronic acid, and copolymers, terpolymers and mixtures thereof, and biodegradable polymers and their copolymers including caprolactone-based polymers, polycaprolactones and copolymers which include polybutylene terephthalate. In one embodiment the depot polymer is selected from the group consisting of polyethylene glycol, dextran, polylactic acid, polyglycolic acid and a copolymer of lactic acid and glycolic acid, and in one specific embodiment the depot polymer is polyethylene glycol. In one embodiment the combined molecular weight of depot polymer(s) linked to the dipeptide element is about 40,000 to 80,000 Daltons, and in one embodiment the depot polymer is polyethylene glycol.

In accordance with one embodiment the depot polymer is linked to the side chain of one of the two amino acids of the dipeptide "A-B" (or to the side chain of a hydroxyl acid present at position "A" of the dipeptide). In one embodiment the dipeptide A-B comprises a cysteine or lysine residue to provide a reactive group for ease of attachment of the depot polymer. In one embodiment the dipeptide A-B comprises a lysine or cysteine wherein a polyethylene glycol having a molecular weight selected from the range of 40,000 to 80,000 Daltons is covalently linked to the lysine or cysteine side chain.

In some embodiments, Q is a glucagon superfamily peptide. In more specific aspects, Q is a glucagon related analog peptide, such as any of those described herein.

In accordance with one embodiment a prodrug derivative of insulin is provided wherein the group

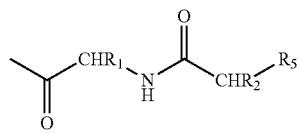

is covalently linked at a position selected from A1, A4 or A21 of the A chain or B5, B9, B16 or B25 of the B chain. In one embodiment the insulin prodrug comprises an A chain of SEQ ID NO: 613 and a B chain of SEQ ID NO: 614 wherein the amino acid at a position selected from A4 or A21 of the A chain or B5, B9 of the B chain has been substituted with a modified amino acid having the structure:

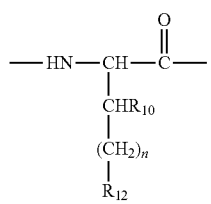

or the amino acid at position B16 or B25 has been substituted with a modified amino acid having the structure

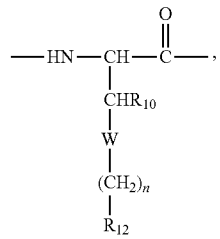

wherein $R_{10}$ is selected from the group consisting of H, $C_1$-$C_4$ alkyl, and $(CH_2)_n(C_6$-$C_{10}$ aryl), W is $C_6$-$C_{10}$ aryl or a bond, and n is an integer from 0 to 3, $R_{12}$ is

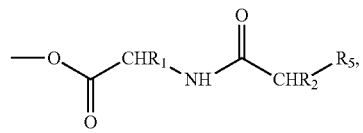

$R_1$ and $R_2$ are independently selected from the group consisting of H, $C_1$-$C_4$ alkyl, $(C_1$-$C_4$ alkyl)OH, $(C_1$-$C_4$ alkyl)SH, $(C_2$-$C_3$ alkyl)SCH$_3$, $(C_1$-$C_4$ alkyl)CONH$_2$, $(C_1$-$C_4$ alkyl)COOH, $(C_1$-$C_4$ alkyl)NH$_2$, $(C_1$-$C_4$ alkyl)NHC(NH$_2$) NH$_2$, $(C_4$-$C_6$)cycloalkyl, $(C_0$-$C_4$ alkyl)($C_6$-$C_{10}$ aryl)$R_9$, and $CH_2$ ($C_5$-$C_9$ heteroaryl), $R_5$ is OH or NH$_2$ and $R_9$=$C_1$-$C_4$ alkyl, NH$_2$ or OH. In one embodiment $R_1$ is selected from the group consisting of CH$_2$ (CH$_3$)$_2$, $(C_4$-$C_5$)cycloalkyl, CH$_2$($C_6$-$C_{10}$ aryl), and CH$_2$($C_5$-$C_9$ heteroaryl) and $R_2$ is selected from the group consisting of $(C_4$-$C_5$)cycloalkyl, CH$_2$($C_6$-$C_{10}$ aryl) and CH$_2$($C_5$-$C_9$ heteroaryl). In one embodiment the insulin prodrug further comprises one or more additional amino acid substitutions at positions selected from A5, A8, A9, A10, A12, A14, A15, A17, A18 A21, B1, B2, B3, B4, B5, B9, B10, B13, B14, B17, B20, B21, B22, B23, B26, B27, B28, B29 and B30, and in one embodiment those amino acid substitutions are conservative amino acid substitutions. Suitable amino acid substitutions at these positions that do not adversely impact insulin's desired activities are known to those skilled in the art, as demonstrated, for example, in Mayer, et al., Insulin Structure and Function, Biopolymers. 2007; 88(5):687-713, the disclosure of which is incorporated herein by reference. In one embodiment the insulin prodrug comprises one to three amino acid substitutions at positions selected from A5, A8, A9, A10, A12, A14, A15, A17, A18, B1, B2, B3, B4, B5, B13, B14, B17, B20, B21, B22, B23, B26, B27, B28, B29 and B30. In one embodiment the insulin prodrug is further modified, relative to the native insulin sequence, by one or more deletions of amino acids from positions B1-5 and B26-30 of the native insulin B peptide, and in another embodiment by the deletion of amino acids B1-5 and/or B26-30. In one embodiment the amino acid at A8 is an amino acid selected from the group consisting of histidine, arginine and lysine. In a further embodiment the amino acid at B10 is an amino acid selected from the group consisting of aspartic acid, glutamic acid, homoglutamic acid, homocysteic acid and cysteic acid.

In accordance with one embodiment an insulin prodrug is provided comprising an A chain and a B chain wherein the A chain comprises a sequence of SEQ ID NO: 626 and the B chain comprises a sequence of SEQ ID NO: 628, further wherein a dipeptide of the general structure

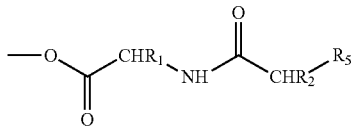

is linked via an ester bond to an amino acid at position A1, A4, A21, B5, B9, B16 or B25, (relative to the native A chain and B chain sequences of SEQ ID NO: 613 and SEQ ID NO: 614, respectively) wherein $R_1$ and $R_2$ are independently selected from the group consisting of H, $C_1$-$C_4$ alkyl, ($C_1$-$C_4$ alkyl) OH, ($C_1$-$C_4$ alkyl)SH, ($C_2$-$C_3$ alkyl)SCH$_3$, ($C_1$-$C_4$ alkyl) CONH$_2$, ($C_1$-$C_4$ alkyl)COOH, ($C_1$-$C_4$ alkyl)NH$_2$, ($C_1$-$C_4$ alkyl)NHC(NH$_2$$^+$) NH$_2$, ($C_4$-$C_6$)cycloalkyl, ($C_0$-$C_4$ alkyl) ($C_6$-$C_{10}$ aryl)$R_9$, and CH$_2$($C_5$-$C_9$ heteroaryl), and $R_5$ is OH or NH$_2$ and $R_9$=$C_1$-$C_4$ alkyl, NH$_2$ or OH. In one embodiment $R_1$ is selected from the group consisting of CH$_2$(CH$_3$)$_2$, ($C_4$-$C_5$)cycloalkyl, CH$_2$($C_6$-$C_{10}$ aryl), and CH$_2$($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl). In one embodiment $R_1$ is selected from the group consisting of CH$_2$(CH$_3$)$_2$, ($C_4$-$C_5$)cycloalkyl, CH$_2$($C_6$ aryl), and CH$_2$($C_5$-$C_6$ heteroaryl) and $R_2$ is selected from the group consisting of ($C_4$-$C_5$)cycloalkyl, CH$_2$($C_6$ aryl) and CH$_2$($C_5$-$C_6$ heteroaryl). In a further embodiment the insulin prodrug further comprises 1-6 or 1-3 amino acid substitutions relative to the sequences of SEQ ID NO: 626 or SEQ ID NO: 628. In one embodiment the B chain of the insulin prodrug comprises the sequence of SEQ ID NO: 627.

In one embodiment the insulin prodrug comprises the sequence of X$_5$IVX$_6$QCCX$_7$SICSLYQLENYCX$_8$ (SEQ ID NO: 626) and X$_{13}$LCGX$_9$X$_{10}$ LVEALX$_{11}$LVCG ERGFX$_{12}$ (SEQ ID NO: 628) wherein X$_6$ is glutamic acid, X$_7$ is selected from the group consisting of threonine, histidine, arginine and lysine, X$_8$ is asparagine or glycine, X$_9$ is serine, X$_{10}$ is selected from the group consisting of aspartic acid, glutamic acid, homocysteic acid and cysteic acid, X$_{11}$ and X$_{12}$ are both tyrosine, X$_{13}$ is histidine and X$_5$ has the structure

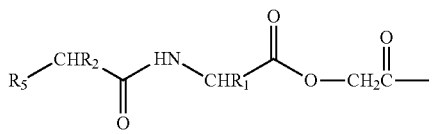

wherein $R_1$ is selected from the group consisting of CH$_2$ (CH$_3$)$_2$, ($C_4$-$C_5$)cycloalkyl, CH$_2$($C_6$-$C_{10}$ aryl), and CH$_2$($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl) and $R_5$ is OH or NH$_2$. In an alternative embodiment the insulin prodrug comprises the sequence X$_5$IVX$_6$QCCX$_7$SICSLYQLENYCX$_8$ (SEQ ID NO: 626) and X$_{13}$LCGX$_9$X$_{10}$LVEALX$_{11}$LVCG ERGFX$_{12}$ (SEQ ID NO: 628) wherein X$_5$ is glycine, X$_7$ is selected from the group consisting of threonine, histidine, arginine and lysine, X$_{10}$ is selected from the group consisting of aspartic acid, glutamic acid, homocysteic acid and cysteic acid, X$_{11}$ and X$_{12}$ are both tyrosine and one of X$_6$, X$_8$, X$_9$ or X$_{13}$ has the structure

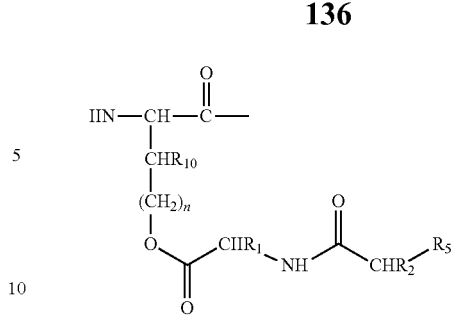

wherein $R_{10}$ is selected from the group consisting of H or CH$_3$, n is 0 or 3, $R_1$ is selected from the group consisting of CH$_2$(CH$_3$)$_2$, ($C_4$-$C_5$)cycloalkyl, CH$_2$($C_6$-$C_{10}$ aryl), and CH$_2$ ($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl) and $R_5$ is OH or NH$_2$. In one embodiment n is 0 and $R_{10}$ is H.

In an alternative embodiment the insulin prodrug comprises the sequence X$_5$IVX$_6$QCCX$_7$SICSLYQLENYCX$_8$ (SEQ ID NO: 626) and X$_{13}$LCGX$_9$X$_{10}$ LVEALX$_{11}$LVCG ERGFX$_{12}$ (SEQ ID NO: 628) wherein X$_5$ is glycine, X$_6$ is glutamic acid, X$_7$ is selected from the group consisting of threonine, histidine, arginine and lysine, X$_8$ is asparagine or glycine, X$_9$ is serine, X$_{10}$ is selected from the group consisting of aspartic acid, glutamic acid, homocysteic acid and cysteic acid, X$_{13}$ is histidine and one of X$_{11}$ and X$_{12}$ is tyrosine or phenylalanine, with the other having the structure

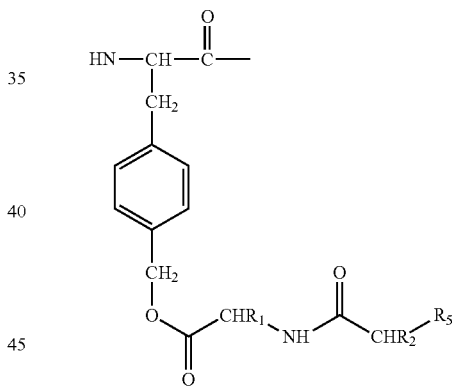

wherein $R_1$ is selected from the group consisting of CH$_2$ (CH$_3$)$_2$, ($C_4$-$C_5$)cycloalkyl, CH$_2$($C_6$-$C_{10}$ aryl), and CH$_2$($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl) and $R_5$ is OH or NH$_2$.

In accordance with one embodiment a prodrug derivative of glucagon or GLP-1 is provided wherein the group

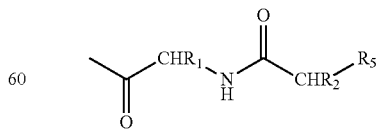

is covalently linked at a position selected from 1, 2, 5, 7, 8 or 11 of the glucagon or GLP-1 peptide. In one embodiment the amino acid at position 2, 5, 7, 8 or 11 of the glucagon or GLP-1 prodrug comprises an amino acid having the structure:

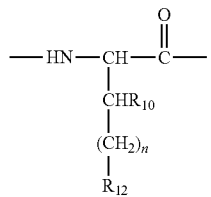

wherein $R_{10}$ is selected from the group consisting of H, $C_1$-$C_4$ alkyl, and $(CH_2)_n(C_6$-$C_{10}$ aryl), wherein n is an integer from 0 to 3, $R_{12}$ is

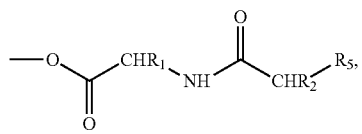

$R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2$)NH$_2$, ($C_4$-$C_6$)cycloalkyl, ($C_0$-$C_4$ alkyl)($C_6$-$C_{10}$ aryl)$R_9$, and CH$_2$($C_5$-$C_9$ heteroaryl), $R_5$ is OH or NH$_2$ and $R_9$=$C_1$-$C_4$ alkyl, NH$_2$ or OH. In one embodiment $R_1$ is selected from the group consisting of CH$_2$(CH$_3$)$_2$, ($C_4$-$C_5$)cycloalkyl, CH$_2$($C_6$-$C_{10}$ aryl), and CH$_2$($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl). In one embodiment the glucagon and GLP-1 prodrugs further comprise one or more amino acid substitutions selected from the group consisting of positions 1, 2, 5, 8, 10, 12, 13, 14, 16, 17, 18, 24, 28 and 29 with respect to the native sequence.

In one embodiment a glucagon prodrug is provided comprising a derivative of SEQ ID NO: 612 wherein the derivative differs from SEQ ID NO: 612 by 1-6 or 1-3 amino acid substitutions at positions selected from positions 1, 2, 5, 7, 8, 10, 12, 13, 14, 16, 17, 18, 24, 28 and 29 and wherein the group

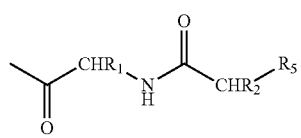

is covalently linked at a position selected from 1, 2, 5, 7, 8 or 11 of the glucagon peptide, wherein $R_1$ is selected from the group consisting of CH$_2$(CH$_3$)$_2$, ($C_4$-$C_5$)cycloalkyl, CH$_2$($C_6$-$C_{10}$ aryl), and CH$_2$($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl) and $R_5$ is OH or NH$_2$.

In one embodiment a GLP-1 prodrug is provided comprising a derivative of SEQ ID NO: 629 wherein the derivative differs from SEQ ID NO: 629 by 1-6 or 1-3 amino acid substitutions at positions selected from positions 1, 2, 3, 5, 8, 10, 12, 13, 14, 16, 17, 18, 24, 28 and 29 relative to the native GLP-1 and wherein the group

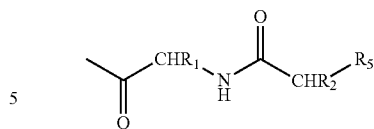

is covalently linked at a position selected from 1, 2, 5, 7, 8 or 11 of the glucagon peptide, wherein $R_1$ is selected from the group consisting of CH$_2$(CH$_3$)$_2$, ($C_4$-$C_5$)cycloalkyl, CH$_2$($C_6$-$C_{10}$ aryl), and CH$_2$($C_5$-$C_9$ heteroaryl) and $R_2$ is selected from the group consisting of ($C_4$-$C_5$)cycloalkyl, CH$_2$($C_6$-$C_{10}$ aryl) and CH$_2$($C_5$-$C_9$ heteroaryl) and $R_5$ is OH or NH$_2$.

In one embodiment the glucagon and GLP-1 derivative comprises an amino acid sequence that differs from the native peptide by a substitution at one or more of positions 1, 2 and 16. In one embodiment the glucagon and GLP-1 derivative comprises an amino acid sequence that differs from the native peptide by a substitution at position 16 wherein the substituting amino acid is selected from the group consisting of Glu, Gln, homoglutamic acid or homocysteic acid. In a further embodiment the glucagon and GLP-1 derivative comprises an amino acid sequence that differs from the native peptide by a substitution at position 1, 2 and/or 16, wherein the substitutions at position 1 are selected from the group consisting of d-histidine, desaminohistidine, hydroxyl-histidine, acetyl-histidine and homo-histidine, and the substitutions at position 2 are selected from the group consisting of d-serine, alanine, glycine, n-methyl serine and amino isobutyric acid.

In accordance with one embodiment a prodrug derivative of GLP-1 or glucagon is provided wherein the prodrug comprises a polypeptide of the general structure:

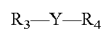

wherein Y is a structure selected from the group consisting of

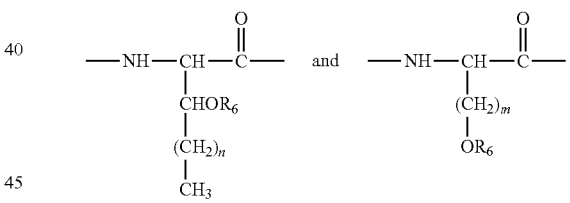

wherein n is an integer selected from 0 to 3 and m is an integer selected from 1-4, $R_3$ is an amino acid sequence selected from the group consisting of $X_1X_2X_3$G-(SEQ ID NO: 621) or

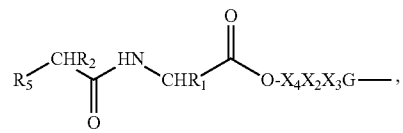

wherein $X_1$ is selected from the group consisting of histidine, hydroxy-histidine, homo-histidine, tyrosine and phenylalanine, $X_2$ is an amino acid selected from the group consisting of glycine, alanine, serine, valine, d alanine, aminoisobutyric acid, N-methyl alanine and similar sized natural and synthetic amino acids, $X_3$ is selected from the group consisting of glutamic acid, aspartic acid, glutamine and asparagine, $X_4$ is selected from the group consisting of desaminohistidine, desaminohomo-histidine, desaminotyrosine and desaminophenylalanine, $R_4$ is an amino acid sequence selected from the group consisting of (SEQ ID NO: 615), (SEQ ID NO: 616), (SEQ ID NO: 617), (SEQ ID NO: 618), and (SEQ ID NO: 619), wherein X at position 11 of SEQ ID NOs: 615-619 is serine, glycine, glutamic acid, glutamine, homoglutamic acid or homocysteic acid, $R_5$ is $NH_2$ or HO;

$R_6$ is H or

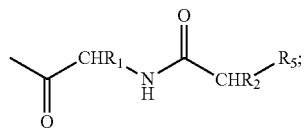

and $R_1$ and $R_2$ are independently selected from the group consisting of H, $C_1$-$C_3$ alkyl, $CH_2CH(CH_3)_2$, $CH(CH_3)$ $(CH_2CH_3)$, $(C_4$-$C_5)$cycloalkyl, $CH_2(C_6$-$C_{10}$ aryl), and $CH_2$ $(C_5$-$C_9$ heteroaryl), and $R_5$ is OH or $NH_2$, with the proviso that when $R_3$ is

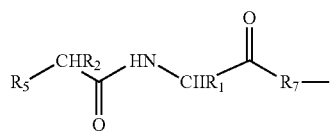

$R_6$ is H, and when $R_6$ is

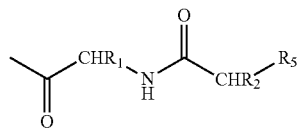

$R_3$ is $X_1X_2X_3G$-(SEQ ID NO: 621), further provided that when $R_6$ is H, $R_3$ is not $X_1X_2X_3G$-(SEQ ID NO: 621). In one embodiment $R_1$ is selected from the group consisting of $CH_2$ $(CH_3)_2$, $(C_4$-$C_5)$cycloalkyl, $CH_2(C_6$-$C_{10}$ aryl), and $CH_2(C_5$-$C_9$ heteroaryl) and $R_2$ is selected from the group consisting of $(C_4$-$C_5)$cycloalkyl, $CH_2(C_6$-$C_{10}$ aryl) and $R_5$ is OH or $NH_2$.

In accordance with one embodiment a prodrug derivative of glucagon or GLP-1 is provided wherein the prodrug comprises a derivative peptide of the sequence HAEGTFTSDVSSYLEGQAAKEFIAWLVKGR (SEQ ID NO: 602) or HSQGTFTSDYSKYLDSRRAQDFVQWLMNT (SEQ ID NO: 612) wherein the derivative peptide comprises 1-6 amino acid substitutions relative to SEQ ID NO: 602 or SEQ ID NO: 612, at positions selected from positions 1, 2, 5, 8, 10-14, 16, 17, 18, 24, 28 and 29 and has a dipeptide of the formula

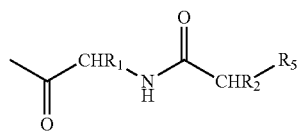

linked to the peptide via an ester bond at a position selected from position 1, 2, 5, 7, 8 and 11. In one embodiment the amino acid at position 2, 5, 7, 8 or 11 is a serine residue and the dipeptide is linked via an ester bond formed with the serine side chain. Typically these prodrugs exhibit less than 10% activity while in the prodrug form and exhibit full activity upon activation.

In accordance with one embodiment a prodrug derivative of GLP-1 is provided. As disclosed in the data provided in Tables 6 and 7 of Example 4, a wide variety of GLP-1 prodrug derivatives have been prepared that that are physically and chemically stable, exhibit enhanced half lives, and convert to the active polypeptide under physiological conditions without the aid of any enzyme. Four of these GLP-1 analogs convert to the active polypeptide under physiological conditions with a half life of greater than 20 hours. These analogs possess a minimal alteration to the native amino acid sequence, and this should minimize potential adverse immunogenic affects. The establishment of prodrug chemistry at the N-terminal end of GLP-1 is anticipated to be translatable for use with other peptides where this specific site is vital to bioactivity.

In accordance with one embodiment prodrug GLP-1 analogs comprise a polypeptide of the general formula of:

$R_3$—Y—$R_4$ wherein Y is a structure selected from the group consisting of

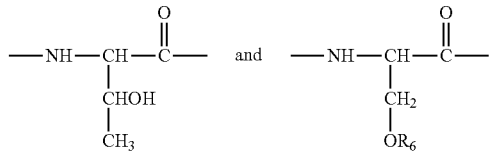

$R_3$ is an amino acid sequence selected from the group consisting of $HX_2QG$-(SEQ ID NO: 635), $FX_2QG$- (SEQ ID NO: 636), $X_1X_2QG$- (SEQ ID NO: 637) or

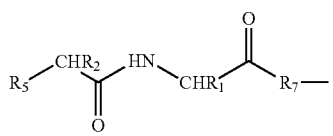

$X_1$ is selected from the group consisting of histidine, hydroxy-histidine, homo-histidine, tyrosine and phenylalanine, $X_2$ is an amino acid selected from the group consisting of glycine, alanine, serine, valine, d alanine, arninoisobutyric acid, N-methyl alanine and similar sized natural and synthetic amino acids, $R_4$ is an amino acid sequence comprising a sequence selected from the group consisting of FTSDVSSYLEGQAAKEFIAWLVKGRG (SEQ ID NO: 603), FTSDVSSYLEGQAAKEFIAWLVKGR-amide (SEQ ID NO: 604), FTSDVSSYLEGQAAKEFIAWLVKGX$_{14}$PSSGAPPPS-amide (SEQ ID NO: 605), wherein $X_{14}$ is Arg or Gly; FTSDVSSYLEGQAAKEFIAWLVKGRGKRNRNNIA (SEQ ID NO: 606), and derivatives of SEQ ID NOs 3, 4, 5 or 6 wherein the derivative differs from SEQ ID NOs: 603, 604, 605 or 606 by one to three amino acids, and in one embodiment differs by one to three conservative amino acids;

$R_5$ is $NH_2$ or HO;
$R_6$ is H or

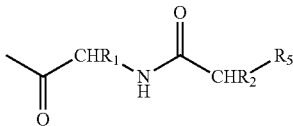

$R_7$ is an amino acid sequence selected from the group consisting of O-HX$_2$QG- (SEQ ID NO: 635), O-FX$_2$QG- (SEQ ID NO: 636), and O-YX$_2$QG- (SEQ ID NO: 638); and
$R_1$ and $R_2$ are independently selected from the group consisting of H, $C_1$-$C_3$ alkyl, $CH_2CH(CH_3)_2$, $CH(CH_3)$ $(CH_2CH_3)$, $(C_4$-$C_5)$cycloalkyl, $CH_2(C_6$ aryl), and $CH_2(C_5$-$C_6$ heteroaryl) with the proviso that when $R_3$ is

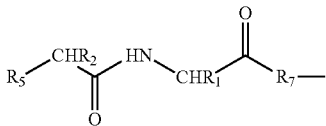

$R_6$ is H, and when $R_6$ is

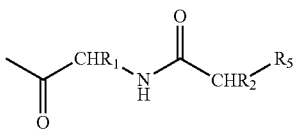

$R_3$ is $R_5HX_2QG$- (SEQ ID NO: 635), $R_5FX_2QG$- (SEQ ID NO: 636) or $R_5YX_2QG$-(SEQ ID NO: 38), further provided that when $R_6$ is H, $R_3$ is not $R_5HX_2QG$- (SEQ ID NO: 635), $R_5FX_2QG$- (SEQ ID NO: 636) or $R_5YX_2QG$- (SEQ ID NO: 638). In one embodiment $R_1$ is selected from the group consisting of $CH_2(CH_3)_2$, $(C_4$-$C_5)$cycloalkyl, $CH_2(C_6$ aryl), and $CH_2(C_5$-$C_6$ heteroaryl) and $R_2$ is selected from the group consisting of $(C_4$-$C_5)$cycloalkyl, $CH_2(C_6$ aryl) and $R_5$ is OH or $NH_2$.

In one embodiment a GLP-1 prodrug is provided having the general structure of Formula V:

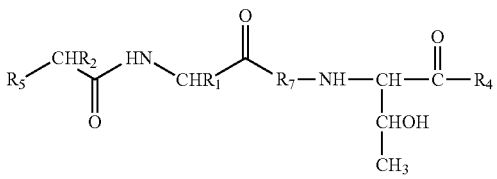

wherein $R_4$ is an amino acid sequence selected from the group consisting of FTSDVSSYLEGQAAKEFI-AWLVKGRG (SEQ ID NO: 603), FTSDVS-SYLEGQAAKEFIAWLVKGR-amide (SEQ ID NO: 604), FTSDVSSYLEGQAAKEFIAWLVKGX$_{14}$PSSGAPPPS-amide (SEQ ID NO: 605),
wherein $X_{14}$ is Arg or Gly;
and derivatives of SEQ ID NOs: 603, 604 or 605 wherein the derivative differs from SEQ ID NOs: 603, 604 or 605 by one to three amino acids, and in one embodiment differs by one to three conservative amino acids;

$R_5$ is $NH_2$ or HO;
$R_7$ is an amino acid sequence selected from the group consisting of O-HX$_2$QG- (SEQ ID NO: 635) and O-FX$_2$QG-(SEQ ID NO: 636);
$X_2$ is an amino acid selected from the group consisting of glycine, alanine, serine, valine, d alanine, aminoisobutyric acid, N-methyl alanine and similar sized natural and synthetic amino acids, and
$R_1$ and $R_2$ are independently selected from the group consisting of H, $C_1$-$C_3$ alkyl, $CH_2CH(CH_3)_2$, $CH(CH_3)$ $(CH_2CH_3)$, $(C_4$-$C_5)$cycloalkyl, $CH_2(C_6$ aryl), and $CH_2(C_5$-$C_6$ heteroaryl).

In accordance with one embodiment a prodrug is provided having the general structure of Formula III or V, wherein $R_1$ is selected from the group consisting of $CH_2(CH_3)_2$, and $CH_2$ $(C_6$ aryl); $R_2$ is $CH_2(C_6$ aryl) and $R_5$ is OH. In a further embodiment $R_4$ is FTSDVSSYLEGQAAKEFIAWLVKGX$_{14}$PSSGAPPPS-amide (SEQ ID NO: 605), wherein $X_{14}$ is Arg or Gly. In another embodiment a prodrug is provided having the general structure of Formula III or V, wherein $R_1$ is $CH_2(CH_3)_2$, and $R_2$ is H or $CH_2(C_6$ aryl) and $R_5$ is $NH_2$. In a further embodiment $R_4$ is FTSDVSSYLEGQAAKEFIAWLVKGX$_5$PSSGAPPPS-amide (SEQ ID NO: 605),
wherein $X_{14}$ is Arg or Gly.

In one embodiment a GLP-1 prodrug is provided having the general structure of Formula III:

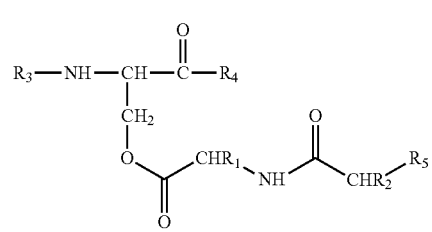

wherein
$R_3$ is an amino acid sequence selected from the group consisting of $R_5$HAQG (SEQ ID NO: 639), $R_5$FAQG (SEQ ID NO: 640), $R_5$YAQG (SEQ ID NO: 641);
$R_4$ comprises an amino acid sequence selected from the group consisting of FTSDVSSYLEGQAAKEFI-AWLVKGRG (SEQ ID NO: 603), FTSDVS-SYLEGQAAKEFIAWLVKGR-amide (SEQ ID NO: 604), and
FTSDVSSYLEGQAAKEFIAWLVKGX$_{14}$PSSGAPPPS-amide (SEQ ID NO: 605),
wherein $X_{14}$ is Arg or Gly;
$R_5$ is $NH_2$ or HO; and
$R_1$ and $R_2$ are independently selected from the group consisting of H, $C_1$-$C_3$ alkyl, $CH_2CH(CH_3)_2$, $CH(CH_3)$ $(CH_2CH_3)$, $(C_4$-$C_5)$cycloalkyl, $CH_2(C_6$ aryl), and $CH_2(C_5$-$C_6$ heteroaryl), and $R_5$ is OH or $NH_2$. In one embodiment $R_1$ is selected from the group consisting of $CH_2(CH_3)_2$, $(C_4$-$C_5)$ cycloalkyl, $CH_2(C_6$ aryl), and $CH_2(C_5$-$C_6$ heteroaryl) and $R_2$ is selected from the group consisting of $(C_4$-$C_5)$cycloalkyl, $CH_2(C_5$-$C_6$ aryl) and $R_5$ is OH or $NH_2$.

In accordance with one embodiment a prodrug is provided having the general structure of Formula III, wherein $R_1$ is selected from the group consisting of $CH_2(CH_3)_2$, and $CH_2$ $(C_6$ aryl); $R_2$ is $CH_2(C_6$ aryl) and $R_5$ is OH. In a further embodiment $R_4$ is FTSDVSSYLEGQAAKEFIAWLVKGX$_{14}$PSSGAPPPS-amide (SEQ ID NO: 605), wherein $X_{14}$ is Arg or Gly. In another embodiment a prodrug is provided having the general structure of Formula III, wherein $R_1$ is $CH_2(CH_3)_2$, and $R_2$ is H or $CH_2(C_6$ aryl) and $R_5$ is $NH_2$ and $R_4$ is FTSDVSSYLEGQAAKEFIAWLVKGX$_{14}$PSSGAPPPS-amide (SEQ ID NO: 605), wherein $X_{14}$ is Arg or Gly. In one embodiment a prodrug is provided having the general structure of Formula VI:

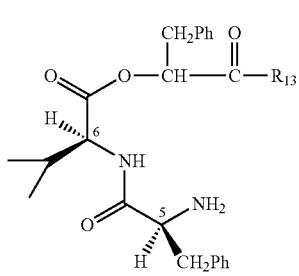

wherein $R_{13}$ is AEGTFTSDVSSYLEGQAAKEFI-AWLVKGRPSSGAPPPS-amide (SEQ ID NO: 608) or AQGTFTSDVSSYLEGQAAKEFI-AWLVKGRPSSGAPPPS-amide (SEQ ID NO: 609), which has a half life of approximately 64 hours.

The bioactivities of the synthetic peptides have been determined using in vitro cellular assays as described in detail in Example 2. In brief, the assay is a cellular based assay wherein a host cell is co-transfected with the GLP-1 receptor and luciferase gene linked to a cAMP responsive element (CRE). The transcription of the luciferase gene is regulated by the cAMP response-element binding protein (CREB) binding to cAMP response element. The cAMP production that is induced is directly proportional to the GLP-1 binding to its receptor which is indicated by the detected activity of the expressed luciferase gene. The prodrugs disclosed herein regained their potencies after incubation in PBS buffer at a pH of 7.2 and temperature of 37° C. Furthermore, the present GLP-1 analogs possess a minimal alteration to the native amino acid sequence, and this should minimize potential adverse immunogenic affects.

The prodrugs disclosed herein can be further modified to improve the peptide's solubility in aqueous solutions at physiological pH, while enhancing the effective duration of the peptide by preventing renal clearance of the peptide. Peptides are easily cleared because of their relatively small molecular size when compared to plasma proteins. Increasing the molecular weight of a peptide above 40 kDa exceeds the renal threshold and significantly extends duration in the plasma. Accordingly, in one embodiment the peptide prodrugs are further modified to comprise a covalently linked hydrophilic moiety. In one embodiment the hydrophilic moiety is a plasma protein polyethylene chain or the Fc portion of an immunoglobin. Therefore, in one embodiment the presently disclosed prodrugs are further modified to comprise one or more hydrophilic groups covalently linked to the side chains of amino acids.

In accordance with one embodiment the insulin prodrugs disclosed herein are further modified by linking a hydrophilic moiety to either the N-terminal amino acid of the B chain or to the amino acid at position 29 of SEQ ID NO: 627. In another embodiment the glucagon and GLP-1 prodrugs disclosed herein are further modified by linking a hydrophilic moiety to the amino acid corresponding to positions 20, 21, 24 of SEQ ID NO: 612 and SEQ ID NO: 602, respectively, or by the addition of a modified amino acid to the carboxy terminus of the glucagon or GLP-1 prodrug. The C-terminally added amino acid is modified to comprise a hydrophilic moiety to the amino acid. In one embodiment the glucagon and GLP-1 prodrugs disclosed herein are further modified by linking a hydrophilic moiety to the amino acid corresponding to position 24 of SEQ ID NO: 612 and SEQ ID NO: 602, respectively. In one embodiment the hydrophilic moiety is selected from the group consisting of a plasma protein polyethylene chain and an Fc portion of an immunoglobin.

In one embodiment the hydrophilic group is a polyethylene chain, and in one embodiment two or more polyethylene chains are covalently attached to two or more amino acid side chains of the prodrug. For the glucagon or GLP-1 prodrugs multiple polyethylene chains can be attached at positions selected from the group 20, 21, 24, or by the addition of a single amino acid at the C-terminus of the peptide wherein the added amino acid has a polyethylene chain linked to its side chain. In one embodiment the amino acid added to the C-terminus is a modified cysteine.

In accordance with one embodiment, the prodrugs disclosed herein are further modified by amino acid substitutions, wherein the substituting amino acid comprises a side chain suitable for crosslinking with hydrophilic moieties, including for example, polyethylene glycol. In one embodiment the amino acid at the position of the prodrug where the hydrophilic moiety is to be linked substituted (or added at the C-terminus of the prodrug) with a natural or synthetic amino acid to introduce, or allow for ease in attaching, the hydrophilic moiety. For example, in one embodiment the native amino acid at position 20, 21, 24 (of the glucagon or GLP-1 prodrugs) is substituted with a lysine or cysteine residue (or a lysine or cysteine residue is added to the C-terminus) to allow for the covalent attachment of a polyethylene chain.

In one embodiment the prodrug has a single cysteine residue added to the carboxy terminus, or the prodrug peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, the prodrug has a single lysine residue added to the carboxy terminus, or the prodrug peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol.

The presently disclosed glucagon and GLP-1 prodrugs encompass amino acid substitutions of the native glucagon and GLP-1 sequences at positions that are known not to be critical to the function of the GLP-1 analog. In one embodiment the substitutions are conservative amino acid substitutions at one, two, three, four, five or six positions selected from the group consisting of 1, 2, 5, 8, 10, 12-14, 16-18, 24, 28 and 29. In one embodiment the amino acids corresponding to positions 20, 21 and 24 of the native GLP-1/glucagon peptide, and more particularly at positions 21 and 24 relative to native GLP-1/glucagon are substituted with cysteine or lysine, wherein a PEG chain is covalently attached to the substituted cysteine or lysine residue. In a further embodiment the C-terminus of the GLP-1 analog is modified to replace the carboxylic acid group with an amide group.

In those embodiments wherein the prodrug comprises a polyethylene glycol chain, the polyethylene chain may be in the form of a straight chain or it may be branched. In accordance with one embodiment the polyethylene glycol chain has an average molecular weight selected from the range of about 20,000 to about 60,000 Daltons. Multiple polyethylene chains can be linked to the prodrugs to provide a prodrug with optimal solubility and blood clearance properties. In one embodiment the prodrug is linked to a single polyethylene glycol chain that has an average molecular weight selected from the range of about 20,000 to about 60,000 Daltons. In another embodiment the prodrug is linked to a two polyethylene glycol chains wherein the combined average molecular weight of the two chains is selected from the range of about 40,000 to about 80,000 Daltons. In one embodiment a single polyethylene glycol chain having an average molecular weight of 20,000 or 60,000 Daltons is linked to the prodrug. In another embodiment a single polyethylene chain is linked to the prodrug and has an average molecular weight selected from the range of about 40,000 to about 50,000 Daltons. In one embodiment two polyethylene glycol chains are linked to the prodrug wherein the first and second polyethylene glycol chains each have an average molecular weight of 20,000 Daltons. In another embodiment two polyethylene glycol chains are linked to the prodrug wherein the first and second polyethylene glycol chains each have an average molecular weight of 40,000 Daltons.

In a further embodiment a glucagon or GLP-1 prodrug comprising two or more polyethylene chains covalently bound to the peptide is provided, wherein the total molecular weight of the glucagon chains is about 40,000 to about 60,000 Daltons. In one embodiment the pegylated glucagon or GLP-1 prodrug comprises a polyethylene glycol chain linked to one or more amino acids at position 20, 21 and 24 of the glucagon or GLP-1 peptide wherein the combined molecular weight of the PEG chain(s) is about 40,000 to about 80,000 Daltons. In one embodiment an insulin prodrug comprising two or more polyethylene chains covalently bound to the peptide is provided, wherein the total molecular weight of the glucagon chains is about 40,000 to about 60,000 Daltons. In one embodiment the pegylated insulin prodrug comprises a polyethylene glycol chain linked to one or more amino acids at the N-terminus of the B chain and/or at position 29 of the B chain (e.g., SEQ ID NO: 627), wherein the combined molecular weight of the PEG chain(s) is about 40,000 to about 80,000 Daltons.

In accordance with one embodiment a glucagon or GLP-1 prodrug is provided comprising the structure of a compound selected from the group consisting of:

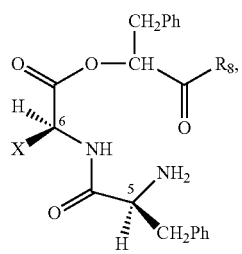

1

L,L-dipeptide extension

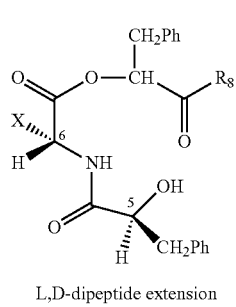

2

L,D-dipeptide extension

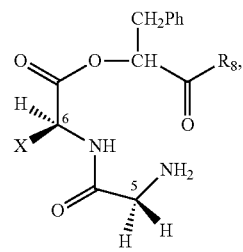

3

L,L-dipeptide extension

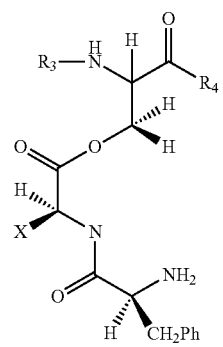

4

L,L-dipeptide extension

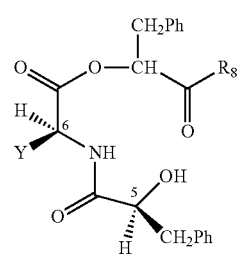

5

L,L-dipeptide extension

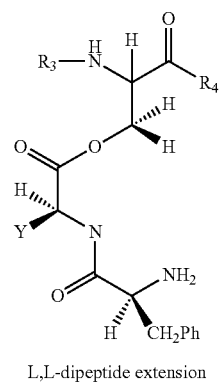

6

L,L-dipeptide extension

-continued

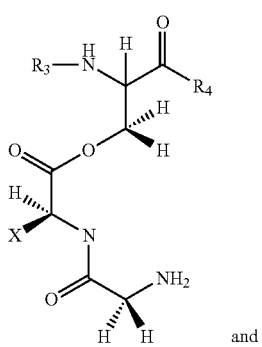

L,L-dipeptide extension

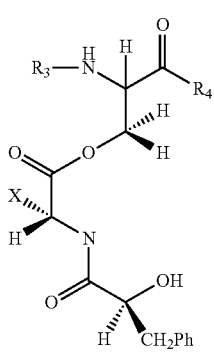

L,D-dipeptide extension wherein X is $CH_2(CH_3)_2$; Y is phenyl, $R_3$ is $X_1X_2X_3G$ (SEQ ID NO: 621), wherein $X_1$ is selected from the group consisting of histidine, hydroxy-histidine, homo-histidine, tyrosine and phenylalanine, $X_2$ is an amino acid selected from the group consisting of glycine, alanine, serine, valine, d alanine, aminoisobutyric acid, N-methyl alanine and similar sized natural and synthetic amino acids, and $X_3$ is selected from the group consisting of glutamic acid, aspartic acid, glutamine and asparagine, $R_4$ is an amino acid sequence selected from the group consisting of FTSDVSSYLEGQAAKEFIAWLVKGRG (SEQ ID NO: 603), FTSDVSSYLEGQAAKEFIAWLVKGR-amide (SEQ ID NO: 604), FTSDVSSYLEGQAAKEFIAWLVKGX$_{14}$PSSGAPPPS-amide (SEQ ID NO: 605), wherein $X_{14}$ is Arg or Gly; FTSDYSKYLDSRRAQDFVQWLMNT (SEQ ID NO: 618), and FTSDYSKYLDSRRAQDFVQWLMNTPSSGAPPPS-amide (SEQ ID NO: 620), $R_8$ is selected from the group consisting of AEGTFTSDVSSYLEGQAAKEFIAWLVKGXPSSGAPPPS-amide (SEQ ID NO: 608), AQGTFTSDVSSYLEGQAAKEFIAWLVKGXPSSGAPPPS-amide (SEQ ID NO: 609), AEGTFTSDVSSYLEGQAAKEFIAWLVKG (SEQ ID NO: 630), AQGTFTSDVSSYLEGQAAKEFIAWLVKG (SEQ ID NO: 631), SQGTFTSDYSKYLDSRRAQDFVQWLMNT (SEQ ID NO: 632), and SQGTFTSDYSKYLDSRRAQDFVQWLMNTPSSGAPPS-amide (SEQ ID NO: 633)

In accordance with one embodiment, $R_8$ comprises a polypeptide selected from the group consisting of AEGTR$_4$ or AQGTR$_4$; $R_3$ is an amino acid sequence selected from the group consisting of OH-HAEG- (SEQ ID NO: 642), HAQG- (SEQ ID NO: 639), HAEG- (SEQ ID NO: 643), FAEG- (SEQ ID NO: 644) and FAQG-(SEQ ID NO: 640) and $R_4$ comprises an amino acid sequence selected from the group consisting of SEQ ID NO: 616 and SEQ ID NO: 618. In one embodiment $R_4$ is selected from the group consisting of FTSDVSSYLEGQAAKEFIAWLVKGRG (SEQ ID NO: 603), FTSDVSSYLEGQAAKEFIAWLVKGR-amide (SEQ ID NO: 604), FTSDVSSYLEGQAAKEFIAWLVKGX$_{14}$PSSGAPPPS-amide (SEQ ID NO: 605), wherein $X_{14}$ is Arg or Gly; and FTSDVSSYLEGQAAKEFIAWLVKGRGKRNRNNIA (SEQ ID NO: 606).

In accordance with one embodiment, a glucagon or GLP-1 prodrug analog is provided wherein a plasma protein has been covalently linked to an amino acid side chain of the peptide to improve the solubility, stability and/or pharmacokinetics of the glucagon or GLP-1 prodrug analog. For example, serum albumin can be covalently bound to the glucagon or GLP-1 prodrug analog presented herein. In one embodiment the plasmid protein is covalently bound to an amino acid corresponding to position 20, 21 or 24 of the peptide of SEQ ID NO: 604 or SEQ ID NO: 612. More particularly, in one embodiment the plasmid protein is bound to an amino acid corresponding to position 21 or 24 of the glucagon or GLP-1 prodrug analog.

In accordance with one embodiment, a glucagon or GLP-1 prodrug analog is provided wherein a linear amino acid sequence representing the Fc portion of an immunoglobin molecule has been covalently linked to an amino acid side chain of glucagon or GLP-1 prodrug analog disclosed herein to improve the solubility, stability and/or pharmacokinetics of the glucagon or GLP-1 prodrug analog. For example, the amino acid sequence representing the Fc portion of an immunoglobin molecule can be covalently bound to position 20, 21 or 24 of the peptide of SEQ ID NO: 604 or glucagon or GLP-1 prodrug. More particularly, in one embodiment the Fc portion is bound to an amino acid corresponding to position 21 or 24 of the glucagon or GLP-1 prodrug analog, wherein the analog comprises the sequence of SEQ ID NO: 604 or SEQ ID NO: 612. The Fc portion is typically one isolated from IgG, but the Fc peptide fragment from any immunoglobin should function equivalently.

The present disclosure also encompasses other conjugates in which prodrugs of the invention are linked, optionally via covalent bonding and optionally via a linker, to a conjugate. Linkage can be accomplished by covalent chemical bonds, physical forces such electrostatic, hydrogen, ionic, van der Waals, or hydrophobic or hydrophilic interactions. A variety of non-covalent coupling systems may be used, including biotin-avidin, ligand/receptor, enzyme/substrate, nucleic acid/nucleic acid binding protein, lipid/lipid binding protein, cellular adhesion molecule partners; or any binding partners or fragments thereof which have affinity for each other.

Exemplary conjugates include but are not limited to a heterologous peptide or polypeptide (including for example, a plasma protein), a targeting agent, an immunoglobulin or portion thereof (e.g. variable region, CDR, or Fc region), a diagnostic label such as a radioisotope, fluorophore or enzymatic label, a polymer including water soluble polymers, or other therapeutic or diagnostic agents. In one embodiment a conjugate is provided comprising a prodrug polypeptide of the present invention and a plasma protein, wherein the plasma protein is selected form the group consisting of albumin, transferin and fibrinogen. In one embodiment the plasma protein moiety of the conjugate is albumin or transferin. In some embodiments, the linker comprises a chain of atoms from 1 to about 60, or 1 to 30 atoms or longer, 2 to 5 atoms, 2 to 10 atoms, 5 to 10 atoms, or 10 to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, the linker provides a functional group that is subject to cleavage by an enzyme or other catalyst or hydrolytic conditions found in the target tissue or organ or cell. In some embodiments, the length of the linker is long enough to reduce the potential for steric hindrance. If the linker is a covalent bond or a peptidyl bond and the conjugate is a polypeptide, the entire conjugate can be a fusion protein. Such peptidyl linkers may be any length. Exemplary linkers are from about 1 to 50 amino acids in length, 5 to 50, 3 to 5, 5 to 10, 5 to 15, or 10 to 30 amino acids in length. Such fusion proteins may alternatively be produced by recombinant genetic engineering methods known to one of ordinary skill in the art.

Applicants have also discovered that native glucagon and GLP-1 can be modified by introducing charge at its carboxy terminus to enhance the solubility of the peptide while retaining the agonist properties of the peptide. The enhanced solubility allows for the preparation and storage of glucagon and GLP-1 solutions at near neutral pH. Formulating glucagon and GLP-1 solutions at relatively neutral pHs (e.g. pH of about 5.0 to about 7.0) improves the long term stability of the analogs.

Applicants anticipate that the glucagon and GLP-1 prodrugs disclosed herein can be similarly modified to enhance their solubility in aqueous solutions at relatively neutral pH (e.g. pH of about 5.0 to about 7.0) while retaining the activities of the parent protein. Accordingly, one embodiment of the present invention is directed to a glucagon or GLP-1 analog that has been further modified relative to the native amino acids to add charge to the peptide by the substitution of native non-charged amino acids with charged amino acids, or the addition of charged amino acids to the carboxy terminus. In accordance with one embodiment, one to three of the non-charged native amino acids of the glucagon or GLP-1 prodrug of the present disclosure are replaced with a charged amino acid. In one embodiment the charged amino acid is selected from the group consisting of lysine, arginine, histidine, aspartic acid and glutamic acid. More particularly, applicants have discovered that substituting the normally occurring amino acid corresponding to positions 28 or 29 (relative to SEQ ID NO: 612) for glucagon or positions 28 or 29 and 30 for GLP-1 (relative to SEQ ID NO: 602) with charged amino acids, and/or the addition of one to two charged amino acids at the carboxy terminus of the glucagon or GLP-1 prodrug, enhances the solubility and stability of the prodrugs in aqueous solutions at physiologically relevant pHs (i.e., a pH of about 6.0 to about 7.0). Such modifications of the glucagon and GLP-1 prodrugs disclosed herein are anticipated to have a similar effect on the solubility in aqueous solutions, particularly at a pH ranging from about 5.0 to about 7.0, while retaining the parent peptide's biological activity Use The disclosed GLP-1, glucagon and insulin prodrugs are believed to be suitable for any use that has previously been described for those bioactive peptides. Accordingly, the prodrugs described herein can be used to treat hypoglycemia, hyperglycemia, or treat other metabolic diseases that result from high/low blood levels of glucagon or high/low blood glucose levels. In accordance with one embodiment the patient to be treated using the prodrug disclosed herein is a domesticated animal, and in another embodiment the patient to be treated is a human.

The method of treating hyperglycemia or hypoglycemia in accordance with the present invention comprises the steps of administering the presently disclosed prodrugs to a patient using any standard route of administration, including parenterally, such as intravenously, intraperitoneally, subcutaneously or intramuscularly, intrathecally, transdermally, rectally, orally, nasally or by inhalation. In one embodiment the composition is administered subcutaneously or intramuscularly. In one embodiment, the composition is administered parenterally and the prodrug composition is prepackaged in a syringe.

Exendin-4, is a peptide made up of 39 amino acids. Stimulators of the GLP-1 receptor have been reported to suppress appetite and induce weight loss. In one embodiment the terminal ten amino acids of Exendin-4 (i.e. the sequence of SEQ ID NO: 624 (GPSSGAPPPS)) are linked to the carboxy terminus of the glucagon and GLP-1 prodrugs of the present disclosure. These fusion proteins are anticipated to have pharmacological activity for suppressing appetite and inducing weight loss/weight maintenance. In accordance with one embodiment a prodrug derivative of the present disclosure comprises a peptide sequence of SEQ ID NO: 602, SEQ ID NO: 612, SEQ ID NO: 622, SEQ ID NO: 623 or SEQ ID NO: 629, further comprising the amino acid sequence of SEQ ID NO: 624 (GPSSGAPPPS) linked to the carboxy terminal sequence of SEQ ID NO: 602, SEQ ID NO: 612, SEQ ID NO: 622, SEQ ID NO: 623 or SEQ ID NO: 629, is administered to individuals to reduce appetite or promote loss of body weight. In accordance with one embodiment the patient is a domesticated animal, and in another embodiment the patient to be treated is a human. Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases. In one embodiment the administered peptide comprises the sequence of SEQ ID NO: 605. While the present invention contemplates that glucagon and GLP-1 prodrugs described herein may optionally be joined to this 10 amino acid carboxy terminal extension (SEQ ID NO: 624), the invention specifically contemplates analogs lacking the 10 contiguous amino acids of SEQ ID NO: 624.

Another compound that induces weight loss is oxyntomodulin, a naturally occurring digestive hormone found in the small intestine (see Diabetes 2005; 54:2390-2395). Oxyntomodulin is a 37 amino acid peptide that contains the 29 amino acid sequence of glucagon followed by an 8 amino acid carboxy terminal extension of SEQ ID NO: 625 (KRNRNNIA). Accordingly, in one embodiment prodrug derivatives of glucagon and GLP-1 are provided that further comprise the carboxy terminal extension of the sequence of SEQ ID NO: 625. More particularly, in accordance with one embodiment a prodrug derivative of the present disclosure comprises a peptide sequence of SEQ ID NO: 602, SEQ ID NO: 612, SEQ ID NO: 622 or SEQ ID NO: 623, further comprising the amino acid sequence of SEQ ID NO: 625 (KRNRNNIA) linked to the carboxy terminal sequence of SEQ ID NO: 602, SEQ ID NO: 612, SEQ ID NO: 622 or SEQ ID NO: 623. These peptide can be used to induce weight loss or prevent weight gain. While the present invention contemplates that glucagon and GLP-1 prodrugs described herein may optionally be joined to this 8 amino acid carboxy terminal extension (SEQ ID NO: 625), the invention specifically contemplates analogs lacking the 8 contiguous amino acids of SEQ ID NO: 625.

The glucagon and GLP-1 prodrugs of the present invention can also be administered to patients suffering from catabolic wasting. It is estimated that over half of cancer patients experience catabolic wasting which is characterized by unintended and progressive weight loss, weakness, and low body fat and muscle. The syndrome is equally common in AIDS patients and can also be present in bacterial and parasitic diseases, rheumatoid arthritis, and chronic diseases of the bowel, liver, lungs, and heart. It is usually associated with anorexia and can manifest as a condition in aging or as a result of physical trauma. Catabolic wasting is a symptom that diminishes the quality of life, worsens the underlying condition, and is a major cause of death.

Combinations

The insulin, glucagon and GLP-1 prodrugs of the invention may be administered alone or in combination with other anti-diabetic or anti-obesity agents. Anti-diabetic agents known in the art or under investigation include insulin, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARy inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; or FBPase (fructose 1,6-bisphosphatase) inhibitors.

Anti-obesity agents known in the art or under investigation include appetite suppressants, including phenethylamine type stimulants, phentermine (optionally with fenfluramine or dexfenfluramine), diethylpropion (Tenuate®), phendimetrazine (Prelu-2®, Bontril®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to xenical (Orlistat) or Cetilistat (also known as ATL-962), or GT 389-255.

Pharmaceutical Compositions

Pharmaceutical compositions comprising the prodrugs disclosed herein can be formulated and administered to patients using standard pharmaceutically acceptable carriers and routes of administration known to those skilled in the art. Accordingly, the present disclosure also encompasses pharmaceutical compositions comprising one or more of the prodrugs disclosed herein, or a pharmaceutically acceptable salt thereof, in combination with a pharmaceutically acceptable carrier. In one embodiment the pharmaceutical composition comprises a 1 mg/ml concentration of the prodrug at pH of about 4.0 to about 7.0 in a phosphate buffer system. The pharmaceutical compositions may comprise the prodrug as the sole pharmaceutically active component, or the prodrugs can be combined with one or more additional active agents. In accordance with one embodiment a composition is provided comprising a glucagon or GLP-1 prodrug of the present invention and insulin or an insulin analog or one of the insulin prodrugs of the present disclosure. Alternatively, a composition is provided for inducing weight loss or preventing weight gain can be provided that comprises a glucagon or GLP-1 prodrug and an anti-obesity peptide. Suitable anti-obesity peptides include those disclosed in U.S. Pat. Nos. 5,691,309, 6,436,435 or US Patent application 20050176643.

In accordance with one embodiment a pharmaceutical composition is provided comprising any of the novel prodrugs disclosed herein, preferably sterile and preferably at a purity level of at least 90%, 91%, 92%, 93%, 94%, 95%, 96%, 97%, 98% or 99%, and a pharmaceutically acceptable diluent, carrier or excipient. Such compositions may contain a glucagon, GLP-1 or insulin prodrug wherein the resulting active peptide is present at a concentration of at least 0.5 mg/ml, 1 mg/ml, 2 mg/ml, 3 mg/ml, 4 mg/ml, 5 mg/ml, 6 mg/ml, 7 mg/ml, 8 mg/ml, 9 mg/ml, 10 mg/ml, 11 mg/ml, 12 mg/ml, 13 mg/ml, 14 mg/ml, 15 mg/ml, 16 mg/ml, 17 mg/ml, 18 mg/ml, 19 mg/ml, 20 mg/ml, 21 mg/ml, 22 mg/ml, 23 mg/ml, 24 mg/ml, 25 mg/ml or higher. In one embodiment the pharmaceutical compositions comprise aqueous solutions that are sterilized and optionally stored within various containers. The compounds of the present invention can be used in accordance with one embodiment to prepare pre-formulated solutions ready for injection. In other embodiments the pharmaceutical compositions comprise a lyophilized powder. The pharmaceutical compositions can be further packaged as part of a kit that includes a disposable device for administering the composition to a patient. The containers or kits may be labeled for storage at ambient room temperature or at refrigerated temperature.

All therapeutic methods, pharmaceutical compositions, kits and other similar embodiments described herein contemplate that prodrug compounds include all pharmaceutically acceptable salts thereof.

Kits

In one embodiment the kit is provided with a device for administering the prodrug composition to a patient. The kit may further include a variety of containers, e.g., vials, tubes, bottles, and the like. Preferably, the kits will also include instructions for use. In accordance with one embodiment the device of the kit is an aerosol dispensing device, wherein the composition is prepackaged within the aerosol device. In another embodiment the kit comprises a syringe and a needle, and in one embodiment the prodrug composition is prepackaged within the syringe.

Methods of Production

The prodrugs described herein may be prepared by standard synthetic methods, recombinant DNA techniques, or any other methods of preparing peptides and fusion proteins, some methods of which are described in the EXAMPLES section. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

EXAMPLES

General Pegylation Protocol: (Cys-Maleimido)

Typically, the GLP Cys analog is dissolved in phosphate buffered saline (5-10 mg/ml) and 0.01M ethylenediamine tetraacetic acid is added (10-15% of total volume). Excess (2-fold) maleimido methoxyPEG reagent (Dow) is added and the reaction stirred at room temp while monitoring reaction progress by HPLC. After 8-24 hrs, the reaction mixture, is acidified and loaded onto a preparative reverse phase column for purification using 0.1% TFA/acetonitrile gradient. The appropriate fractions were combined and lyophilized to give the desired pegylated derivatives.

Example 1

Synthesis of Glucagon and GLP-1 Analogs

Figure 3:
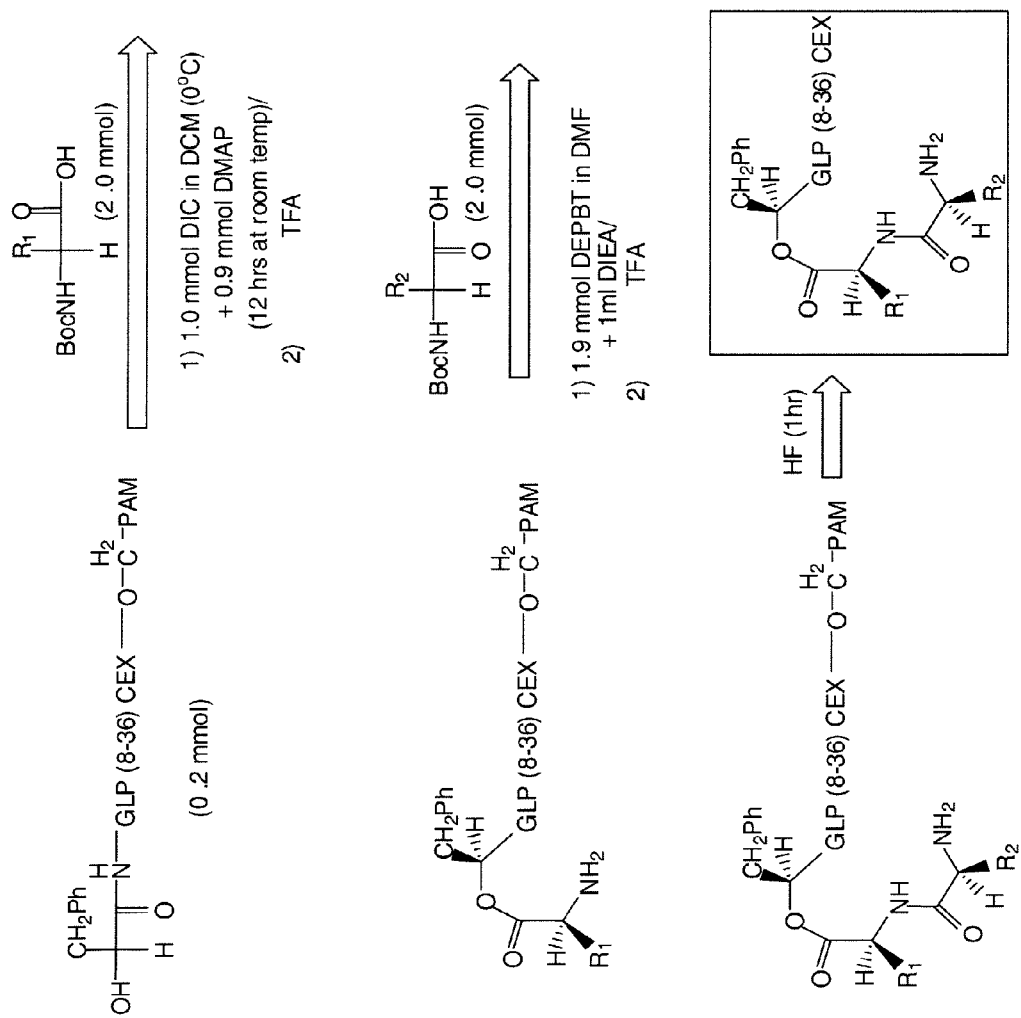
FIG. 3 is a synthetic scheme for preparing ester linked, amine nucleophile dipeptide prodrugs.
Figure 4:
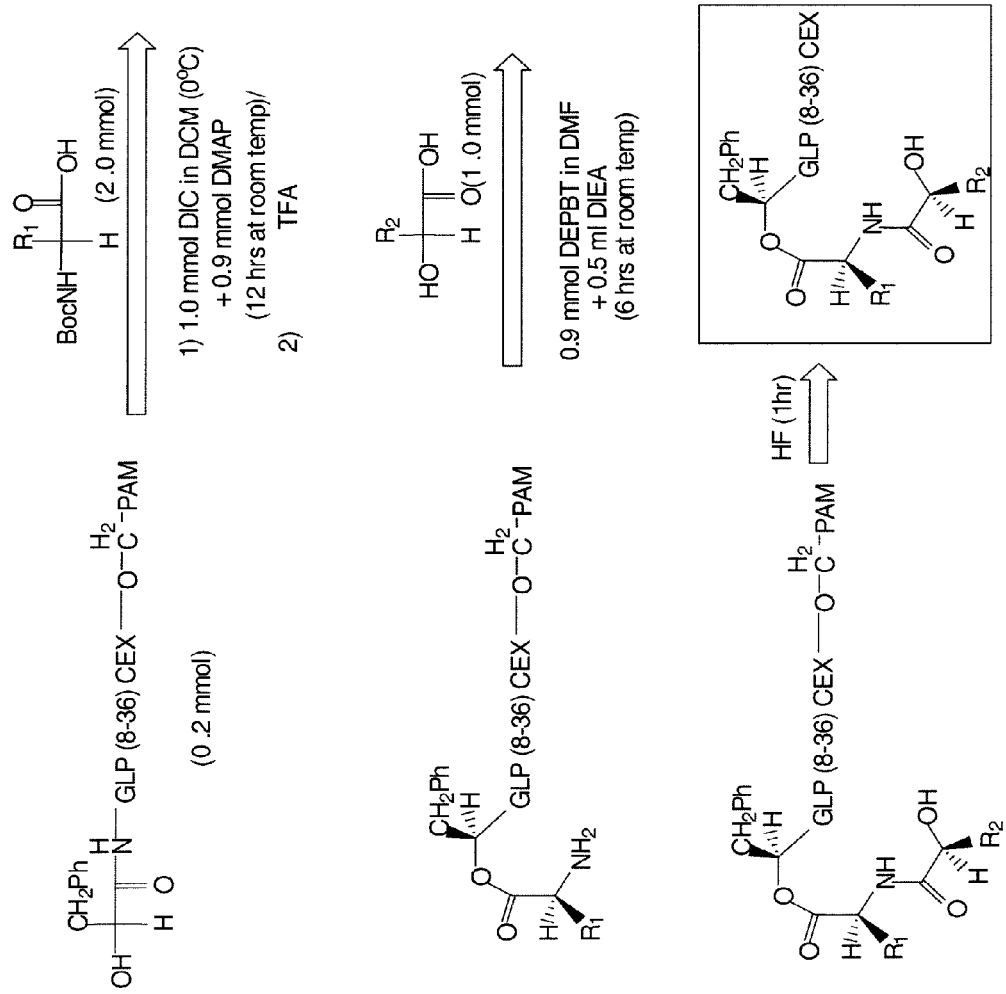
FIG. 4 is a synthetic scheme for preparing ester linked, hydroxyl nucleophile dipeptide prodrugs.

To investigate the possibility of preparing prodrugs derivative of glucagon and GLP-1, numerous peptide analogs were synthesized. The standard procedure is described briefly here and in FIGS. 3 and 4, and the details are discussed later.

Materials:

PAM resin (PAM resin is $OCH_2$-phenylacetamidomethyl-copolystyrene-1% divinylbenzene), (100-180 mesh, 1% DVB cross-linked polystyrene; loading of 0.7-1.0 mmol/g), Boc-protected and Fmoc protected amino acids were purchased from Midwest Biotech. Other reagents such as the α-hydroxy-acids (phenyllactic acid and glycolic acid) were purchased from Aldrich. The solid phase peptide syntheses using Boc-protected amino acids were performed on an Applied Biosystem 430A Peptide Synthesizer. Fmoc protected amino acid synthesis was performed using the Applied Biosystems Model 433 Peptide Synthesizer. The manual synthesis of depsi-peptides was performed in sintered reaction vessels using analogous procedures (Schnolzer, M., et al., (1992) Int J Pept Protein Res 40(3-4):180-193).

Peptide Synthesis (Boc Amino Acids/HF Cleavage):

Synthesis of these analogs was performed on the Applied Biosystem Model 430A Peptide Synthesizer. Synthetic peptides were constructed by sequential addition of amino acids, and activated esters of each amino acid were generated by the addition of 1.9 mmol (3.8 ml of a 0.5M solution) of 3-(Diethoxy-phosphoryloxy)-3H-benzo[d][1,2,3]triazin-4-one (DEPBT) in DMF to a cartridge containing 2 mmol of Boc protected amino acid. The amino acids were dissolved by bubbling Nitrogen gas through the cartridge. 1 ml of N,N-Diisopropylethylamine was added to the cartridge to effect ester formation. This solution was transferred to the reaction vessel containing the 0.2 mmol of the C-terminal residue attached to the PAM resin, vortexed several times, and allowed to couple to the resin for 10 minutes. After washing to remove the unreacted reagents, the N-terminal Boc protecting group was removed by treatment with trifluoroacetic acid (TFA) for 5 minutes. The resin was washed with DMF and the cycle was repeated for the desired number of steps until the chain was assembled. The reaction vessel at the end of the synthesis (typically 30 amino acids) contained approximately 1.2-1.5 g of protected peptidyl-PAM resin. The resin was washed numerous times with dimethylformamide (DMF), treated with trifluoroacetic acid to remove the last tBoc protecting group and finally washed several additional times with DMF, dichloromethane (DCM) and dried.

The peptidyl-resin was treated with anhydrous HF (procedure detailed later in this section), and this typically yielded approximately 350 mg (~50% yield) of a crude deprotected-peptide.

Peptide Synthesis (Fmoc Amino Acids/HF Cleavage):

This synthesis scheme was performed manually with a few amino acids at selective sites. In this work, the Fmoc amino acids were used only to synthesize the internal serine prodrugs, as a part of a wider synthetic strategy. Here, it is to be noted that although FMOC chemistry has been used in the synthesis, the peptides have always been built on PAM resin that required treatment with HF to cleave the peptide from the solid support. The yield of these peptides is approximately as stated earlier for Boc/PAM synthesis.

The synthesis was carried out as described in the previous section. At the end of the coupling step, the peptidyl-resin was treated with 20% piperidine to remove the N-terminal Fmoc protecting group. It was washed repeatedly with DMF and this repetitive cycle was repeated for the desired number of coupling steps. The peptidyl-resin at the end of the entire synthesis was dried by using DCM, and the peptide was cleaved from the resin with anhydrous HF.

Depsi-Peptide Synthesis (Amino Ester Formation)

In this case, the peptidyl-resin had an α-hydroxyl-N terminal extension instead of a N-terminal amine and the acylation was done at the a hydroxyl group. This reaction takes a longer time than that of the amide bond formation, as the hydroxyl group is a weaker nucleophile as compared to the amine. The reaction time was typically 12 hours.

Initially, the activated esters of each amino acid were generated by the addition of 1 mmol (0.155 ml of Diisopropylcarbodiimide (DIC) to a cartridge containing a solution of 2 mmol of Boc protected amino acid residue in 2 ml DCM. This was cooled to 10° C. for 10 minutes. 0.9 mmol (244 mg) of dimethylaminopyridine (DMAP) was added to the cartridge to accelerate ester formation. This mixture was transferred to the reaction vessel containing the peptidyl-resin upon which the peptide was synthesized. The reaction vessel was stirred for 12 hours.

The peptidyl-resin was dried using DCM and the synthesis of the desired peptide was continued. The peptidyl-resin at the end of the entire synthesis was dried by using DCM, and finally treated with anhydrous HF to generate the desired peptide.

N-Terminal Hydroxyl Peptide Synthesis (α Hydroxyl-N Terminal Extension)

In this reaction, the free amine of the peptidyl-resin reacts with an α hydroxyl acid to form an α hydroxyl-N terminal extension. In this regard, only two such a hydroxyl acids were used namely, glycolic acid (OH-glycine) and phenyllactic acid (OH-phenylalanine). These syntheses were also performed manually. The peptides were constructed by addition of the a hydroxyl acid, and activated esters of the a hydroxyl acid were generated by the addition of 0.9 mmol of DEPBT (270 mg) to a cartridge containing a solution of 1 mmol of Boc protected residue in 2 ml DMF. 0.5 ml of DIEA (N, N-Diisopropylethylamine) was added to the cartridge to accelerate ester formation. This mixture was transferred to the reaction vessel containing the peptidyl-resin upon which the peptide was synthesized. The reaction time was 6 hours.

The peptidyl-resin was dried using DCM and the synthesis of the desired peptide was continued. The peptidyl-resin at the end of the entire synthesis was dried by using DCM, and cleaved by anhydrous HF to generate the free peptide.

HF Treatment of the Peptidyl-Resin

The peptidyl-resin (30 mg to 200 mg) was placed in the hydrogen fluoride (HF) reaction vessel for cleavage. 500 μL of p-cresol was added to the vessel as a carbonium ion scavenger. The vessel was attached to the HF system and submerged in the methanol/dry ice mixture. The vessel was evacuated with a vacuum pump and 10 ml of HF was distilled to the reaction vessel. This reaction mixture of the peptidyl-resin and the HF was stirred for one hour at 0° C., after which a vacuum was established and the HF was quickly evacuated (10-15 min). The vessel was removed carefully and filled with approximately 35 ml of ether to precipitate the peptide and to extract the p-cresol and small molecule organic protecting groups resulting from HF treatment. This mixture was filtered utilizing a teflon filter and repeated twice to remove all excess cresol. This filtrate was discarded. The precipitated peptide dissolves in approximately 20 ml of 10% acetic acid (aq). This filtrate, which contained the desired peptide, was collected and lyophilized.

Analysis Using Mass Spectrometry

The mass spectra were obtained using a Sciex API-III electrospray quadrapole mass spectrometer with a standard ESI ion source. Ionization conditions that were used are as follows: ESI in the positive-ion mode; ion spray voltage, 3.9 kV; orifice potential, 60 V. The nebulizing and curtain gas used was nitrogen flow rate of 0.9 L/min. Mass spectra were recorded from 600-1800 Thompsons at 0.5 Th per step and 2 msec dwell time. The sample (about 1 mg/mL) was dissolved in 50% aqueous acetonitrile with 1% acetic acid and introduced by an external syringe pump at the rate of 5 µL/min.

When the peptides were analyzed in PBS solution by ESI MS, they were first desalted using a ZipTip solid phase extraction tip containing 0.6 µL C4 resin, according to instructions provided by the manufacturer (Millipore Corporation, Billerica, Mass., see http://www.millipore.com/catalogue.nsf/docs/C5737).

High Pressure Liquid Chromatography (HPLC) Analysis:

Preliminary analyses were performed with these crude peptides to get an approximation of their relative conversion rates in Phosphate Buffered Saline (PBS) buffer (pH, 7.2) using high performance liquid chromatography (HPLC) and MALDI analysis. The crude peptide samples were dissolved in the PBS buffer at a concentration of 1 mg/ml. 1 ml of the resulting solution was stored in a 1.5 ml HPLC vial which was then sealed and incubated at 37° C. Aliquots of 100 µl were drawn out at various time intervals, cooled to room temperature and analyzed by HPLC.

The HPLC analyses were performed using a Beckman System Gold Chromatography system using a UV detector at 214 nm. HPLC analyses were performed on a 150 mm×4.6 mm C18 Vydac column. The flow rate was 1 ml/min. Solvent A contained 0.1% TFA in distilled water, and solvent B contained 0.1% TFA in 90% $CH_3CN$. A linear gradient was employed (40% to 70% B in 15 minutes). The data were collected and analyzed using Peak Simple Chromatography software.

The initial rates of hydrolysis were used to measure the rate constant for the dissociation of the respective prodrugs. The concentrations of the prodrug and the drug were estimated from their peak areas respectively. The first order dissociation rate constants of the prodrugs were determined by plotting the logarithm of the concentration of the prodrug at various time intervals. The slope of this plot gives the rate constant 'k'. The half lives of the degradation of the various prodrugs were then calculated by using the formula $t_{1/2}=0.693/k$.

Preparative Purification Using HPLC:

Once a prodrug displaying an appropriate $t_{1/2}$ was identified, the prodrug was purified. The purification was performed using HPLC analysis on a silica based 1×25 cm Vydac C18 (5µ particle size, 300A° pore size) column. The instruments used were: Waters Associates model 600 pump, Injector model 717, and UV detector model 486. A wavelength of 214 nm was used for all samples. Solvent A contained 10% $CH_3CN$/0.1% TFA in distilled water, and solvent B contained 0.1% TFA in $CH_3CN$. A linear gradient was employed (0 to 100% B in 2 hours). The flow rate is 1.2 ml/min and the fraction size was 6 ml. From ~350 mgs of crude peptide, 80 mgs of the pure peptide (~23% yield) was typically obtained.

Example 2

Bioassay Experimental Design: Luciferase-Based Reporter Gene Assay for cAMP Detection The ability of each glucagon and GLP-1 analog or prodrug to induce cAMP was measured in a firefly luciferase-based reporter assay. The cAMP production that is induced is directly proportional to the glucagon or GLP-1 binding to its receptor. HEK293 cells co-transfected with the glucagon or GLP-1 receptor, respectively, and luciferase gene linked to a cAMP responsive element were employed for the bioassay.

The cells were serum-deprived by culturing 16 hours in Dulbecco Minimum Essential Medium (Invitrogen, Carlsbad, Calif.) supplemented with 0.25% Bovine Growth Serum (HyClone, Logan, Utah) and then incubated with serial dilutions of either GLP-1 analogs or prodrugs for 5 hours at 37° C., 5% $CO_2$ in 96 well poly-D-Lysine-coated "Biocoat" plates (BD Biosciences, San Jose, Calif.). At the end of the incubation, 100 µL of LucLite luminescence substrate reagent (Perkin Elmer, Wellesley, Mass.) were added to each well. The plate was shaken briefly, incubated 10 min in the dark and light output was measured on MicroBeta-1450 liquid scintillation counter (Perkin-Elmer, Wellesley, Mass.). The effective 50% concentrations ($EC_{50}$) were calculated by using Origin software (OriginLab, Northampton, Mass.).

Example 3

Bioactivity of GLP-1 Amide-Based Prodrugs

I) GLP-Oxyntomodulin

The GLP-oxyntomodulin chimeric peptide (SEQ ID NO: 610) of which the last eight amino acids were derived from oxyntomodulin was synthesized.

(SEQ ID NO: 610)
HAEGTFTSDVSSYLEGQAAKEFIAWLVKGRGKRNRNNIA

The rationale behind synthesizing this chimeric peptide was two-fold: (1) to demonstrate that a peptide of a mass of around 4300 Da could be synthesized and (2) if this peptide is shown to be biologically potent, then a GLP-1 analog with an extended C-terminus could be used as a base sequence for GLP-1 peptides having other modifications.

The GLP-oxyntomodulin peptide was found to have a mass of 4322.5 Daltons. The receptor binding activity of GLP-oxyntomodulin peptide was determined by the GLP-receptor luciferase assay described in Example 2 to be at least as potent as the native GLP-1 peptide in the luciferase assay.

II) Adding Dipeptides to the N Terminus

To study the ability of prodrugs to intramolecularly cyclize, cleave, and form a diketopiperazine (DKP) or diketomorpholine (DMP), different dipeptides were covalently attached to the N-terminus of GLP-1 (aa 7-37). The biologically inactive, dipeptide-extended GLP-1 peptides were designed for conversion into the active peptide drug (GLP-1 (aa7-37) upon cleavage of the amide bond along with formation of DKP or DMP. This is represented schematically in FIGS. 5A and 5B. Prodrugs of varying half lives were envisioned by chemically modifying the side chains of the amino acids of the dipeptide ($R_1$ and $R_2$).

The first peptide synthesized (named $G^5P^6H^7$,GLP(8-37)) comprised a Gly-Pro dipeptide attached to the N-terminus of GLP-1 (aa7-37). The peptide was prepared synthetically by solid phase synthesis as described above. The synthesis was confirmed by MALDI-MS analysis (3509.5 Da).

GLP-1(aa7-37)-based peptide prodrugs comprising either a Pro-Pro dipeptide or a Pro-His dipeptide were similarly synthesized. The dipeptide extension Gly-Phe or Phe-Phe were synthesized to facilitate DPK formation by sterically assisting in the cleavage of the amide bond. It was hypothesized that the cis-orientation of proline would contribute in the facilitation of the dipeptide's adoption of an optimal steric conformation for the formation of DKP.

With regard to the peptide comprising the Pro-His dipeptide, the carbonyl bond of interest was sandwiched between two histidines (amino acid Y and the histidyl leaving group). This design was directed at a proton assisted cleavage of the amide bond via diketopiperazine formation.

An acid-base catalyzed general hydrolysis of the amide bond was attempted by synthesizing peptides comprising an addition of a single amino acid (γ-Glu, Glu, Phe, or His). Since, the leaving group would be the histidine at the N-terminus of the active peptide (GLP-1(aa7-37), it was purported that the imidazole ring might assist in the cleavage by general acid-base catalysis.

Each N-terminally extended peptide was incubated in PBS buffer at 37° C. for approximately a week. Alternatively, each peptide was heated for 120 min at 100° C. to accelerate the amide bond cleavage. Cleavage of the prodrugs was analyzed by reverse phase HPLC and MS. As shown in Table 1, none of the amide bonds of any of the peptides cleaved, demonstrating the robustness of the amide bond (Table 1).

TABLE 1

Attempted cleavage of $H^7$,GLP(7-37) prodrugs to form native GLP-1(aa7-37)

| Compound No. | Peptide ($Xaa^1Yaa^2$-GLP1) | Rate of cleavage at 100° C. | Rate of cleavage at 37° C. |
|---|---|---|---|
| 1 | GP | No cleavage | No cleavage |
| 2 | PP | No cleavage | No cleavage |
| 3 | γ Glu | No cleavage | No cleavage |
| 4 | E | No cleavage | No cleavage |
| 5 | P | No cleavage | No cleavage |
| 6 | H | No cleavage | No cleavage |
| 7 | PH | No cleavage | No cleavage |

In Compounds 4, 5 and 6, a single amino acid was added to the N terminus of GLP-1.

In all cases, there is a histidine in the 1$^{st}$ position (histidyl leaving group) of GLP-1.

Based on these data, it was hypothesized that the imidazole nucleus was playing an attenuating role in the cleavage of the amide bond. To test this possibility, peptides having a different leaving group were studied. Specifically, peptides comprising aa 7-37 of GLP-1 with the His at position 7 replaced with Phe (named $F^7$,GLP(8-37)) were synthesized and purified using the procedure described above. This peptide was determined as a full agonist having 10% the potency of native GLP. Dipeptides were added to the N-terminus of $F^7$,GLP(8-37) to study the cleavage of the amide bond between the dipeptide and the N-terminus of the active peptide ($F^7$,GLP (8-37)) and formation of DKP. In a first peptide prodrug of $F^7$,GLP(8-37), Gly-Pro was added to the N-terminus, whereas in a second peptide prodrug, sarcosine was used, as it has been previously reported to enhance the rate of cleavage (Hamel, A. R. et al., (2004) *Journal of Peptide Research* 63: 147-154)). Although both dipeptide extensions were designed to sterically assist in the cleavage of the amide bond, the amide bond remained resistance to cleavage (Table 2).

TABLE 2

Attempted cleavage of dipeptide extended $F^7$,GLP(7-37)

| Compound No | Peptide ($Xaa^1Yaa^2$—$F^{7a}$-GLP8-37) | Rate of cleavage at 100° C. | Rate of cleavage at 37° C. |
|---|---|---|---|
| 1 | GP | No cleavage | No cleavage |
| 2 | GSar$^b$ | No cleavage | No cleavage |

$^a$In all cases there is phenylalanine in the 1$^{st}$ position (phenylalanyl leaving group) of GLP.
$^b$Sar represents sarcosine III) Adding Dipeptides to the N Terminus of $F^7$,GLP(8-36)-CEX The $F^7$,GLP(8-37) analogs were found to exhibit poor solubility in PBS at 37° C. Hence, a modified GLP-1 analog of SEQ ID NO: 611 (named GLP(7-36)-CEX amide) comprising the last ten amino acids of Exendin-4 with a C-terminal amide in place of an acid group was prepared.

(SEQ ID NO: 611)
H$^7$AEGTFTSDVSSYLEGQAAKEFIAWLVKGXPSSGAPPPS-amide

GLP(7-36)-CEX amide had been observed to be approximately ten times more potent in vitro than the native GLP-1 sequence, and analogs of this peptide were found to be appreciably more soluble in PBS.

Prodrugs of an analog of GLP(7-36)-CEX amide in which Phe replaced the His at position 7 were synthesized comprising a Gly-Gly dipeptide ($G^5G^6F^7$,GLP(8-36)-CEX) or an OH-Gly-Gly dipeptide, in which the alpha amino group was replaced with a hydroxyl group (OH-$G^5G^6F^7$,GLP(8-36)-CEX). These peptides were tested to check the effect of the less bulky glycyl leaving group and to determine if either of the nucleophiles (amine or hydroxyl) could cleave the amide bond by 2,5-diketopiperazine or 2,5-diketomorpholine formation respectively and thus regenerate the active $F^7$,GLP(8-36)-CEX peptide. Cleavage of the prodrugs were tested as described above and the results are shown in Table 3.

TABLE 3

Attempted cleavage of dipeptides added to the N terminus of $G^7$,GLP(7-36)CEX

| Compound No | Peptide (Xaa1Yaa2—$G^{7a}$GLP-CEX) | Rate of cleavage at 100° C. | Rate of cleavage at 37° C. |
|---|---|---|---|
| 3 | GG | No cleavage | No cleavage |
| 4 | HO—GG | No cleavage | No cleavage |

$^a$In all these cases there is glycine in the 1$^{st}$ position (glycyl leaving group) of GLP.

Based on the results shown in Table 3, it was concluded that the amide bond is very difficult to cleave under physiological conditions either by 2,5-diketopiperazine (DKP) or 2,5-diketomorpholine (DMP) formation. This is independent of the nucleophiles and leaving groups tested, even under elevated temperature.

Example 4

Bioactivity of GLP-1 Ester-Based Prodrugs

IV) Depsipeptides and Esters

Depsi-peptides were synthesized through addition of dipeptides to the hydroxyl group at the N terminus of another peptide via an ester linkage. The coupling procedures are described in the experimental section and they proved highly effective. As before, dipeptides of differential tendency for intramolecular cyclization (diketopiperazine formation) and release of the parent drug (N-terminal hydroxyl peptide) were studied. While adding the dipeptide, both an amine nucleophile cleaving an ester bond and a hydroxyl nucleophile cleaving an ester bond were prepared and studied.

V) Adding Dipeptides to the OH Terminus of HO-F$^7$,GLP(8-36)-CEX

Figure 2:
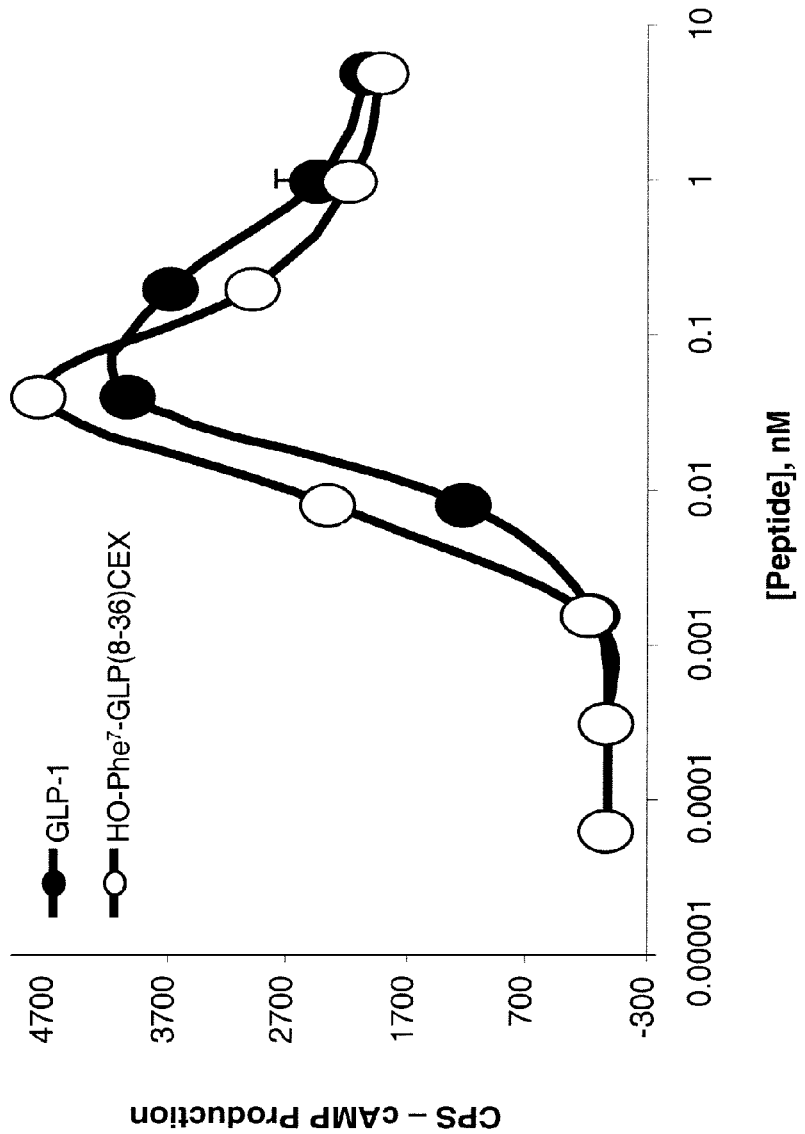
FIG. 2 is a graph demonstrating the bioassay results for GLP-1 analog HO-F7,GLP(8-36)-CEX (○) relative to GLP-1 (●).

The HO-F$^7$,GLP(8-36)-CEX peptide was synthesized from the GLP(8-36)-CEX PAM resin (the synthetic scheme is represented in FIG. 1) and served as the parent drug for these experiments. This peptide has an $EC_{50}$ value of 0.008 nM (FIG. 2) while native GLP-1 has an $EC_{50}$ value of 0.011 nM. Therefore, the HO-F$^7$,GLP(8-36)-CEX was found to be at least as potent as the native GLP-1. This is a most important and a somewhat unexpected observation that the histidine can be substituted by phenyllactic acid. This warranted additional validation. Subsequent experiments yielded identical results. The possibility exists that this result is a function of the CEX extension in the HO-F$^7$,GLP(8-36)-CEX. In this regard, it has been reported that the C-terminal region of exendin-4 increases its affinity to the GLP-1 receptor.

The α hydroxyl group of HO-F$^7$,GLP(8-36)-CEX was acylated and both an amine nucleophile cleaving an ester bond; FIG. 5A and a hydroxyl nucleophile cleaving an ester bond; FIG. 5B compounds were prepared and studied. Along with the 2,5-diketopiperazine (amine nucleophile) or 2,5-diketomorpholine (hydroxyl nucleophile), the biologically active HO-F$^7$,GLP(8-36)-CEX is released as shown in FIGS. 5A and 5B.

To explore the possible formation of 2,5-diketopiperazine (DKP) or 2,5-diketomorpholine (DMP) and the simultaneous generation of HO-F$^7$,GLP(8-36)-CEX, the prodrug was incubated in PBS buffer at 37° C. for approximately a week. The peptide was also heated at 100° C. to determine the susceptibility to cleavage (Table 4).

TABLE 4

Cleavage of dipeptide extended HO—F$^7$,GLP(7-36)-CEX

| Peptide No | Peptide (Yaa1Xaa2—O-Phe$^7$-GLP-8-36-CEX) | $t_{1/2}$* of cleavage at 37° C. |
|---|---|---|
| 1 | Gly-Gly | 0.87 hrs |
| 2 | HO-Gly-Gly | 1.13 hrs |
| 3 | HO-Phe-Val | No cleavage |
| 4 | HO-Phe-dVal | 50.58 hrs |
| 5 | HO-Phe-Ala | 2.83 hrs |
| 6 | HO-Phe-dAla | 2.41 hrs |
| 7 | HO-Phe-Gly | 2.46 hrs |
| 8 | HO-Phe-Phe | 33.31 hrs |
| 9 | HO-Phe-dPhe | 7.65 hrs |
| 10 | Phe-Val | 64.0 hrs |

*$t_{1/2}$ is the time required for 50% release of the HO-Phe-GLP8-36-CEX at 37° C. in PBS (pH7.2). It is calculated by a standard first order reaction plot. All these esters, including #3 cleaved at 100° C.. In all these cases, there is HO-Phe in the 1$^{st}$ position (hydroxy phenylalanyl leaving group) of GLP.

The first two peptides shown in Table 4 (Peptides 1 and 2) were analyzed to determine if either of the nucleophiles (amine or hydroxyl) could cleave the ester bond by DKP or DMP formation respectively. The results validated our expectation that the esters are more susceptible to cleavage than the amides. The relatively slower rate of cleavage of peptides 3, 4, 8, 9 and 10 suggest that the bulk of the dipeptide extensions (Phe or Val) greatly affect the rate of prodrug cleavage. While there is virtually no difference between a methyl and a hydrogen side chain (peptide 5, 6 and 7), the presence of an isopropyl group (β branching) greatly attenuates the rate of ester cleavage as evidenced in peptides 3, 4 and 10. Peptide 10 dissociates faster than peptide 3 as the amine is a stronger nucleophile as compared to the hydroxyl, a point corroborated by peptides 1 and 2 as well. Finally, the large difference in the $t_{1/2}$ between peptides 8 and 9 indicates that the side chain interactions in the dipeptide (R1 and R2 in FIGS. 5A and 5B) play an important role as well. This same effect is shown in peptides 3 and 4. In both instances, the L,D-dipeptide diastereoisomer cleaves faster than the corresponding L,L-diastereoisomer.

The structure of peptides 4, 8 and 10 are represented as shown in FIGS. 6A-6C. The observed half life of the prodrug increases as the substituent X gets bulkier (peptides 3, 4, 8, 9 and 10 in Table 4). This is probably because the transition state (TS) is more sterically hindered as the size of X increases. Consequently, the energy of activation increases thereby increasing the stability of the prodrug.

This is especially exemplified for the two pairs of stereoisomers (peptides 3 and 4; 8 and 9). Here, by changing the stereochemistry of a single amino acid in the C-terminus of the dipeptide extension, a huge difference in rate was observed. The steric hindrance of the corresponding transition states is far greater in a L,L-dipeptide diastereoisomer as compared to a L,D-diastereoisomer. Hence, peptide 3 has a greater $t_{1/2}$ as compared to peptide 4, and peptide 8 has a $t_{1/2}$ greater than peptide 9.

Peptide 10 is F$^5$V$^6$-O-F$^7$,GLP(8-36)-CEX. This has a $t_{1/2}$ of 64 hrs and represents the longest duration peptidic prodrug to cleavage under physiological conditions. The transition state in this case is sizably hindered because of the steric interaction between the phenylalanyl and the valyl side chain.

The cleavage of peptide 10 (FIG. 6B) (4264 Da) to form the parent drug HO-F$^7$,GLP(8-36)-CEX (4019 Da) is an intramolecular cyclization. Therefore it is assumed that the presence of other impurities do not affect the rate of internal dissociation. In addition, both the prodrug and the drug have been followed with a MALDI analysis even in the midst of contaminating peptides.

A second set of analogous depsipeptides were also studied to further examine the effects of the dipeptide extension structure upon the rate of cleavage (Table 5). Their synthesis follows the same pattern as outlined in FIGS. 3 and 4. The major difference is that in this case, the R2 or Y site is a less hindered hydrogen (glycyl residue) instead of a bulky phenylalanyl. In this case a glycolic acid (OH-glycine) or a glycine were used at the terminal end of the prodrug.

TABLE 5

Cleavage of ester bond in HO—G$^5$X$^6$—O—F$^7$,GLP(7-36)CEX

| Compound No | Peptide (Yaa1Xaa2—O-Phe$^7$-GLP-8-36-CEX) | $t_{1/2}$ of cleavage at 37° C. |
|---|---|---|
| 1 | Gly-Gly | 0.87 hr |
| 2 | HO-Gly-Gly | 1.13 hrs |
| 3 | HO-Gly-Val | 4.70 hrs |
| 4 | HO-Gly-dVal | 5.13 hrs |
| 5 | HO-Gly-[1]AIB | 0.75 hrs |
| 6 | HO-Gly-[2]PhG | 0.49 hrs |
| 7 | HO-Gly-[3]tBut | Did not cleave |
| 8 | HO-Gly-Phe | 0.70 hrs |
| 9 | HO-Gly-dPhe | 0.93 hrs |
| 10 | Gly-Val | 20.38 hrs |

$t_{1/2}$ is the time required for 50% release of the HO-Phe-GLP8-36-CEX at 37° C. in PBS (pH7.2). It is calculated by a standard first order reaction plot. All these esters cleaved at 100° C.. In all these cases, there is OH-Phe in the 1$^{st}$ position (hydroxy phenylalanyl leaving group) of GLP.
[1]AIB: α-aminoisobutyric acid;
[2]PhG: phenylglycine;
[3]tBut: tertiary butyl;

The analysis was completed in the same manner as explained previously. The first two peptides shown in Table 4 (Peptides 1 and 2) were analyzed to determine if either of the nucleophiles (amine or hydroxyl) could cleave the ester bond by 2,5-diketopiperazine or 2,5-diketomorpholine formation respectively. These two peptides had been analyzed in Table 5 and were tested again to serve as positive controls. As expected, both of the nucleophiles studied could cleave the ester bond. This set of compounds (Compounds 2 to 9 in Table 5) are expected to cleave faster than in the previous case, as the steric bulk is removed. As the size of X becomes structurally bulkier, the transition state gets increasingly crowded. Consequently, the energy of activation increases thereby increasing the stability of the prodrug. This is what is seen in compound 10 where X is an isopropyl (valine) group (see FIG. 6D for the compounds structure). When X is a tertiary butyl group (compound 7), the compound does not cleave at all in PBS buffer (pH, 7.2) at 37° C. In Table 5, the pairs of stereoisomers (compounds 3 and 4; 8 and 9) dissociate at nearly the same rate. This is probably because the stereoisomers do not show a large difference in energy (purportedly because of the non-chiral nature of glycine). Hence, in this case, both the glycyl,L-dipeptide extension and the glycyl,D-dipeptide extension have a comparable energetic transition state.

The observation that compound 3 dissociates faster than compound 10 seems to suggest that the hydroxyl is a stronger nucleophile as compared to the amine at a pH of 7.2 and 37° C. One possible explanation for this anomaly might be that the pKa of the N-terminal amine is slightly increased in compound 10. As a result, at a pH of 7.2, this amine nucleophile would be disproportionately protonated and thus account for the slower rate of prodrug cleavage.

Thus, our results indicate that the structural nature of the side chain (especially β branching as evidenced in dipeptides containing valine and tert-butyl glycine); the stereochemistry and the pKa of the nucleophile serve a role in determining the relative rate of cleavage. Several fast and slow cleaving ester prodrug candidates have been identified which were tested for their biopotency.

VI) Bioassays of Selected Longer-Acting Prodrug Candidates

Four of the longer duration prodrugs were chosen for further analysis in the biopotency tests. Luciferase-based bioassays were performed after purifying all peptides by HPLC and confirming their masses by MALDI-MS analysis. Percent potency was calculated for purposes of comparing the mean $EC_{50}$ of the parent with that of the respective prodrug. The results are tabulated in Table 6.

TABLE 6

Bioassay of select longer-acting ester prodrugs

| Analog No | Peptide ($t_{1/2}$): (Yaa1Xaa2—O-Phe-GLP-8-36-CEX) | $EC_{50}$ ± Std. deviation (nM) | % potency with respect to parent |
|---|---|---|---|
| 1 | HO—$F^7$-GLP8-36 CEX (parent drug candidate) | 0.028 ± 0.006 | 100% (parent drug) |
| 2 | HO-Phe-dVal ($t_{1/2}$ = 50.5 hrs) | 0.40 ± 0.06 | 7% |
| 3 | Phe-Val ($t_{1/2}$ = 64.0 hrs) | 2.070 ± 0.41 | 1.3% |
| 4 | HO-Phe-Phe ($t_{1/2}$ = 33.3 hrs) | 0.771 ± 0.249 | 3.6% |
| 5 | Gly-Val ($t_{1/2}$ = 20.3 hrs) | 0.230 ± 0.10 | 12% |

These observations clearly show that addition of an ester linked dipeptide sequence to the terminal-hydroxyl group of the parent drug drastically reduces the potency of the drug. Two peptides were further analyzed to demonstrate that the prodrugs revert towards the potency of the parent drug following incubation for 24 hours, in PBS (pH, 7.2). The peptides chosen were analogs 4 and 5, based upon their $t_{1/2}$ values (Table 6).

Figure 7:
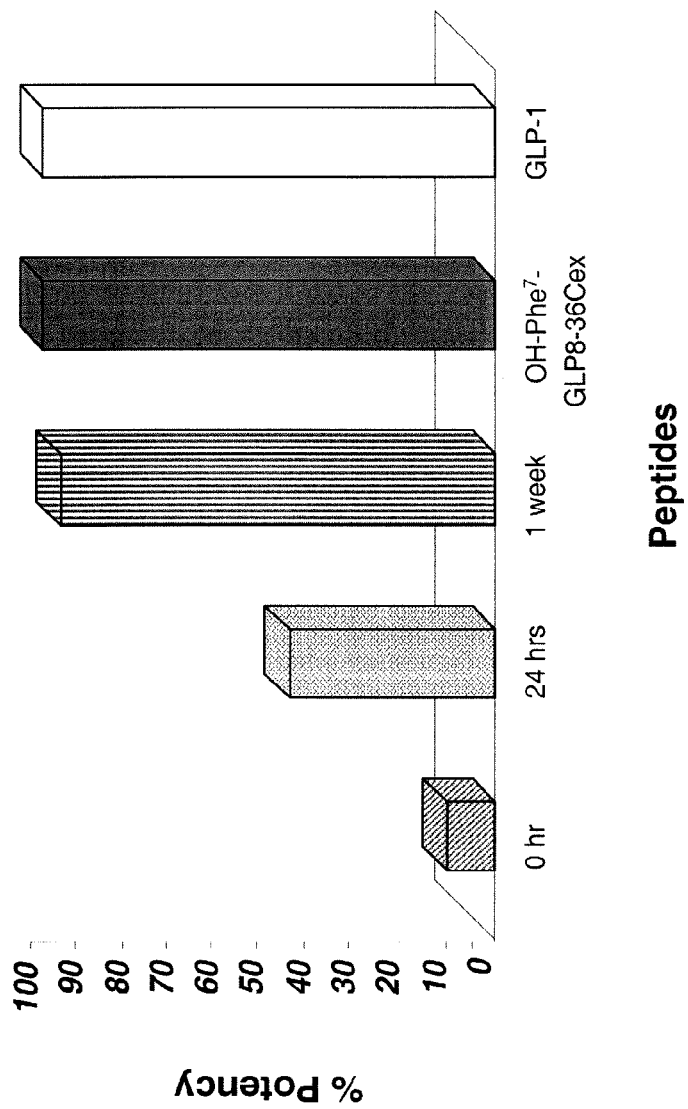
FIG. 7 is a bar graph representing bioassay data showing the relative potency of G$^5$V$^6$-O-F$^7$,GLP(8-36)CEX over time relative to appropriate GLP-1 controls.
Figure 8:
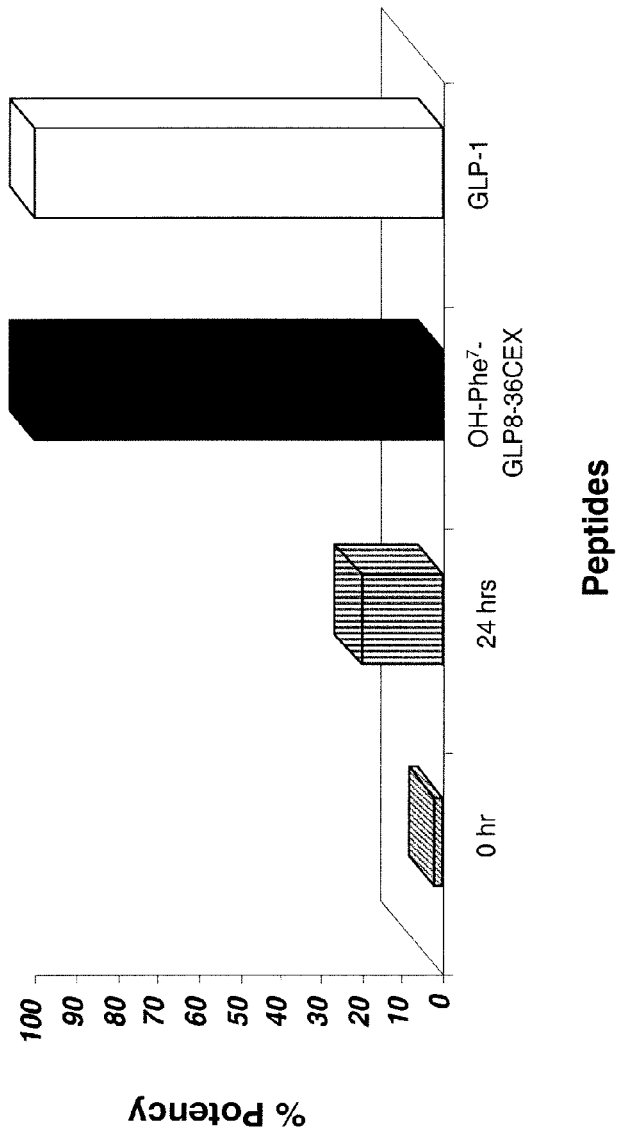
FIG. 8 is a bar graph representing bioassay data showing the relative potency of HO-F$^5$F$^6$-O-F$^7$,GLP(8-36)-CEX over time relative to appropriate GLP-1 controls.
Figure 11A:
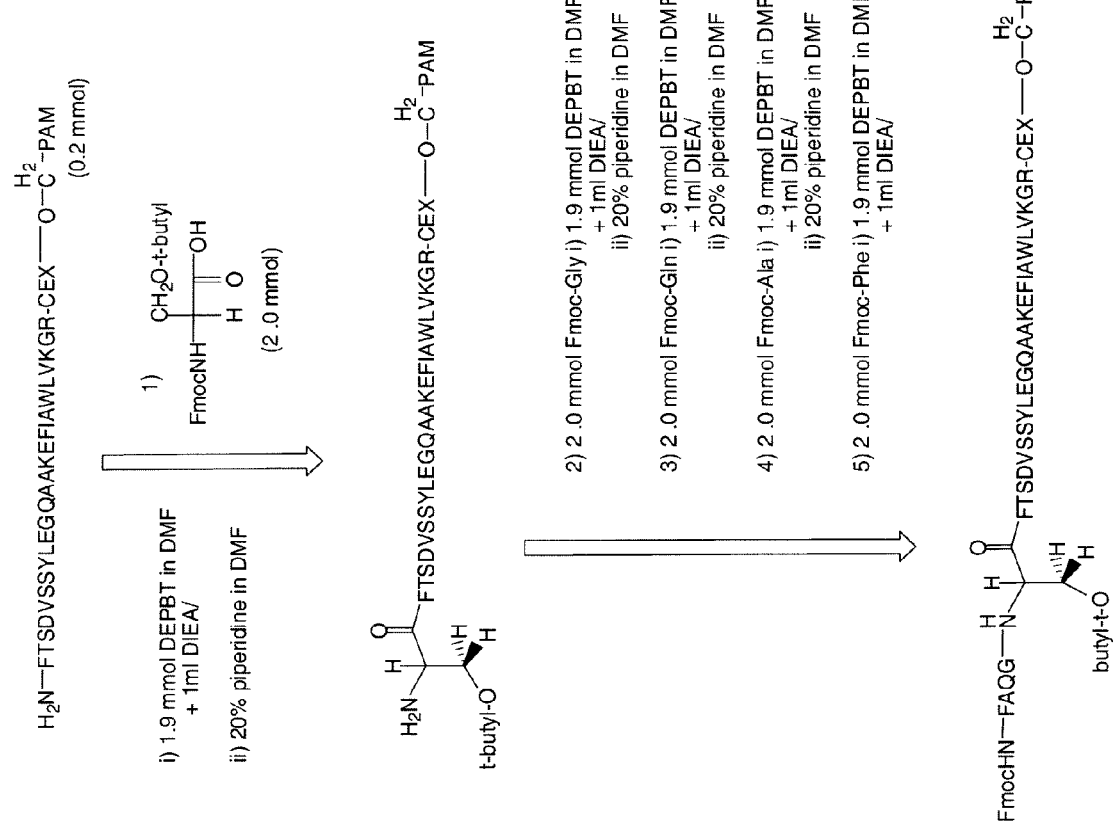
FIG. 11A-11C provide a synthetic scheme for the synthesis of (H7F),(E9Q),[T11S-Oβ-(Gly-Gly)],GLP(8-36)-CEX.
Figure 11B:
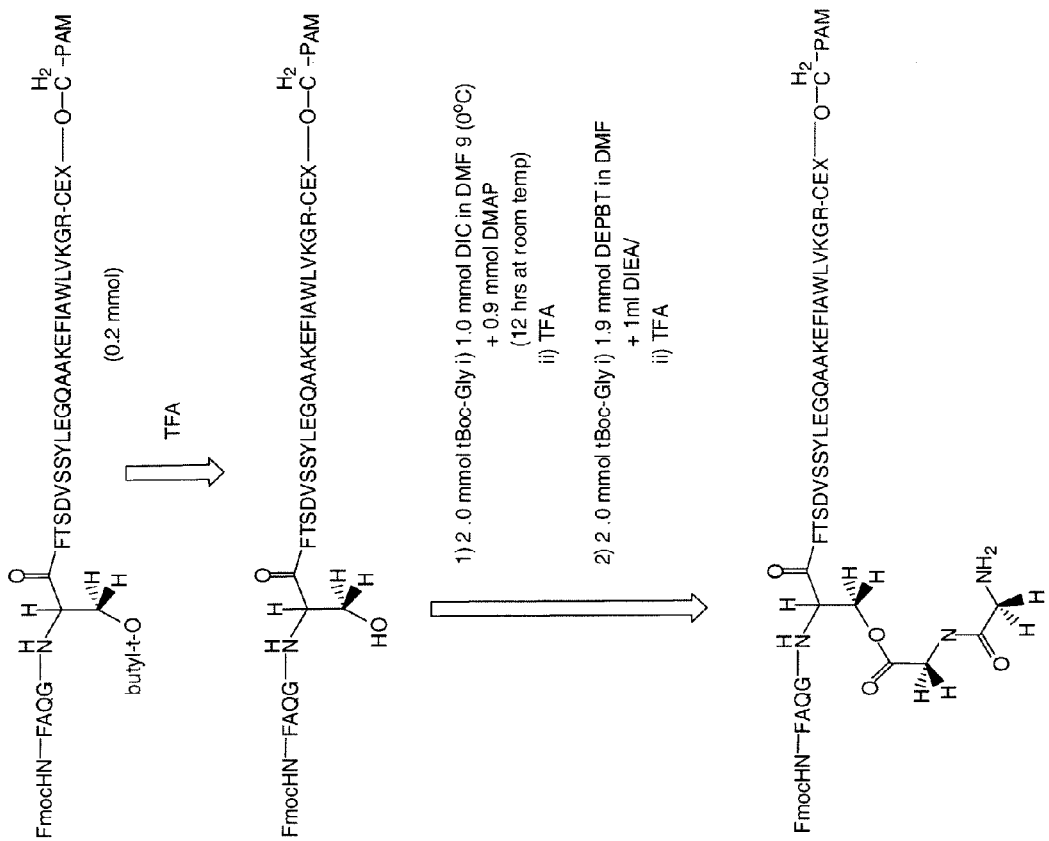
Figure 11C:
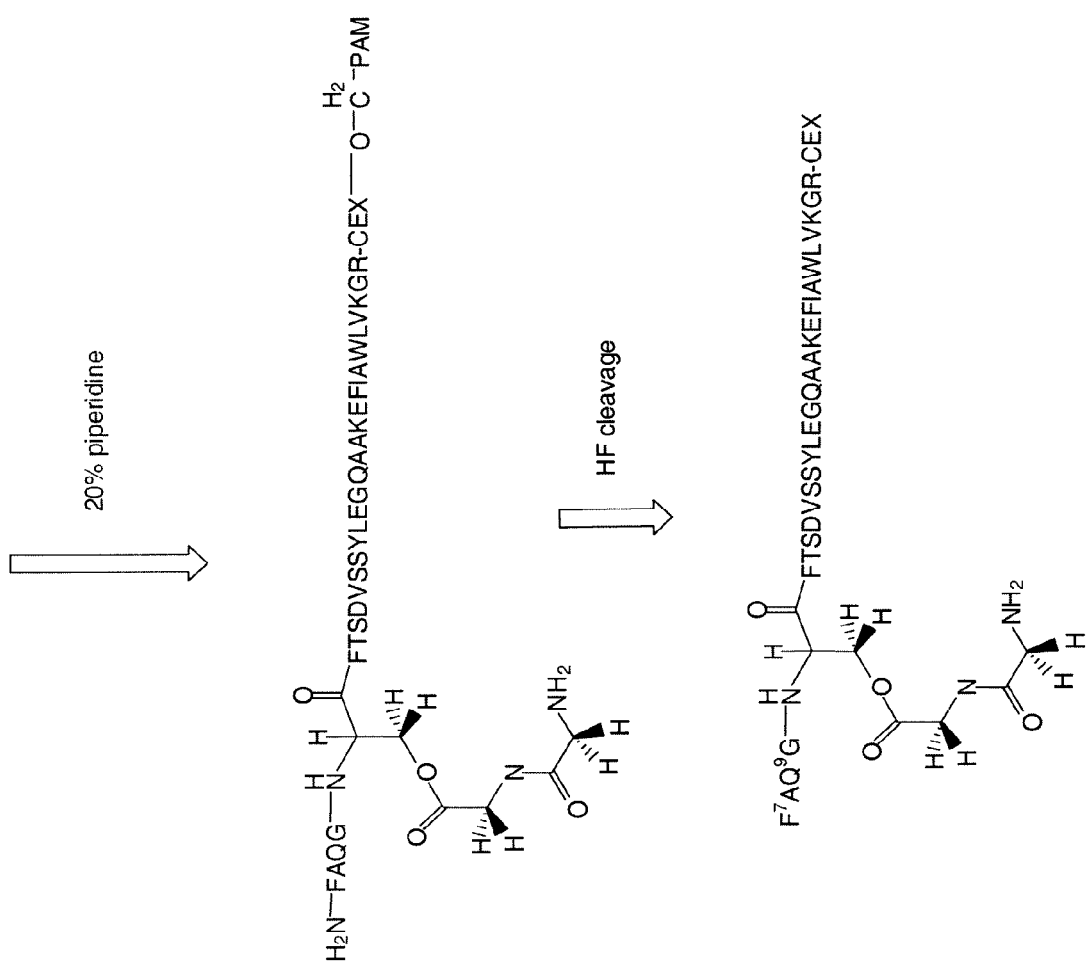

These experiments were performed using HPLC purified samples with the luciferase-based assay. Percent potency calculations were done comparing the mean $EC_{50}$ of the parent with that of the prodrug. The results are tabulated in Table 7 and then pictorially represented in FIGS. 7 and 8.

TABLE 7

Bioassay results that show the conversion of prodrugs to drugs

| Analog No | Peptide ($t_{1/2}$): (Yaa1Xaa2—O-Phe-GLP-8-36-CEX) | $EC_{50}$ ± Std. deviation (nM) | % potency with respect to parent |
|---|---|---|---|
| GLP-1 parent | HO—$F^7$-GLP8-36-CEX (parent drug candidate) | 0.023 ± 0.010 | 100% (parent drug) |
| $5^{(168\,hrs)}$* | Gly-Val ($t_{1/2}$ = 20.3 hrs) incubated for 168 hrs. | 0.024 ± 0.012 | 95.8% |
| $4^{(0\,hrs)}$ | HO-Phe-Phe ($t_{1/2}$ = 33.3 hrs) before incubation. | 0.612 ± 0.270 | 3.7% |
| $4^{(24\,hrs)}$ | HO-Phe-Phe ($t_{1/2}$ = 33.3 hrs) incubated for 24 hrs. | 0.134 ± 0.050 | 17.2% |
| $5^{(0\,hrs)}$ | Gly-Val ($t_{1/2}$ = 20.3 hrs) before incubation. | 0.211 ± 0.072 | 10.9% |
| $5^{(24\,hrs)}$ | Gly-Val ($t_{1/2}$ = 20.3 hrs) incubated for 24 hrs. | 0.05 ± 0.020 | 46% |

*Analog 5 after incubation in PBS for a week (potency almost completely restored).
$^{( )}$Time inside parenthesis refers to the time of incubation of the respective peptide Analog 5 from Table 7 has its potency converted close to that of the parent drug after incubation for a week. Both prodrugs display a higher potency after being incubated in PBS for 24 hours due to gradual conversion to the parent drug (see FIGS. 7 and 8).

VII) Ester Prodrugs from Internal Sites of the Peptide

The prodrugs disclosed herein spontaneously convert under physiological conditions (pH=7.2 and temperature=37° C.) to yield the parent drug. pH and temperature are relied upon for this conversion, as they are virtually invariant physiologically and this also eliminates the need for any specific enzyme mediated processing of the prodrug to its active form. The prodrug chemistry that has been established at the N-terminal end should also be translatable for use at internal bioactive sites from which an ester prodrug can be prepared.

To make an ester prodrug, a judicious choice of serine/threonine residue was explored at which the dipeptide could be added. The peptide must be biologically active before the addition of the dipeptide and inactive after the addition, in analogous fashion to our results at the terminal end of GLP-1. Hence, the peptide variants were tested for biological activity prior to pursuit of the prodrug modified forms.

Synthesis and Analysis of Prodrugs at Internal Sites

Two peptides were synthesized as possible starting points for development of internal prodrug candidates. The first peptide was (H7F),(E9Q),GLP(8-36)-CEX and the second one was (H7F),(E9Q),(T11S),GLP(8-36)-CEX. The synthesis of an ester prodrug was attempted at the hydroxyl group of the $5^{th}$ amino acid (threonine or serine side chain of (H7F), (E9Q),GLP(8-36)-CEX and (H7F),(E9Q),(T11S),GLP(8-36)-CEX, respectively). For these molecules, a Boc benzyl-type synthesis on a PAM resin was conducted until the point of Phe at the $12^{th}$ position. The rest of the synthesis was completed using Fmoc-based chemistry. This offered the opportunity to selectively remove the protecting group of the serine side chain, leaving all the other protecting groups intact. This allowed for the selective acylation on the free hydroxyl group of the serine at the 11$^{th}$ position.

More specifically a Boc-benzyl strategy could not be used throughout the synthesis as the hydroxyl protecting benzyl group of serine would require HF treatment for removal. Consequently, an ester prodrug could not be synthesized on the peptidic resin as the HF treatment would simultaneous remove the peptide from the resin. This is why a Ser was added at the 11$^{th}$ position (Fmoc-O-t butyl-L-seine) and the subsequent Gly, Gln, Ala and Phe as Fmoc-protected amino acids. The t-butyl protecting group of the serine was selectively removed by treatment with TFA for 2 hours. The Boc-protected dipeptidic pro-moiety was added to this hydroxyl group to finish the synthesis of the ester prodrug. The final Boc-protecting group was removed by treatment with TFA and the N-terminal Fmoc group was removed by treatment with 20% piperidine in DMF. This was found to be a useful strategy to build the dipeptide esters from the hydroxyl side chain of serine and threonine residues. The glutamic acid residue at the 3$^{rd}$ position was also replaced with glutamine to prevent any unwanted coupling on the side chain carboxyl group. It was assumed that this would not lead to a loss of activity as previous reports have suggested that the 3$^{rd}$ position is not critical for GLP-1 potency.

The bio-assay was conducted after purification of these peptides by HPLC, and confirmation of their masses by MALDI as described previously. Percent potency was calculated and the mean EC$_{50}$ of the peptide (drug candidate) was compared with that of native GLP-1. The results are tabulated in Table 8 and then shown in FIG. 9.

TABLE 8

Bioassay results of internal serine/threonine drug candidates

| Compound No | Peptide (t$_{1/2}$) | EC$_{50}$ ± Std. deviation (nM) | % potency with respect to GLP-1 |
|---|---|---|---|
| 1 | GLP-1 | 0.02 ± 0.00 | 100% |
| 2 | F$^7$Q$^9$S$^{11}$-GLP8-36 CEX | 0.10 ± 0.02 | 20% |
| 3 | F$^7$Q$^9$T$^{11}$-GLP8-36 CEX | 0.06 ± 0.02 | 33.33% |

GLP-1 was used as a standard.

The peptides (H7F),(E9Q),GLP(8-36)-CEX and (H7F),(E9Q),(T11S),GLP(8-36)-CEX were full agonists with 20% and 33.3% the potency of native GLP-1 respectively. It was decided that both these peptides were sufficiently potent for development as potential drug candidates.

A Gly-Gly dipeptide was envisioned to be added to these GLP-1 analogs as an initial investigation of its synthetic ease. The hydroxyl group of the serine side chain was easier to acylate as compared to the bulkier threonine side chain. One potential prodrug (H7F),(E9Q),[T11S-O$^\beta$-(Gly-Gly)],GLP (8-36)-CEX was synthesized by adding a Gly-Gly dipeptide to the hydroxyl of the serine side chain. In this regard, the t$_{1/2}$ of the Gly-Gly terminal ester prodrugs were ~1 hr (Table 5), whereas the t$_{1/2}$ of the internal ester prodrug was found to be approximately three times longer.

It was observed that the (H7F),(E9Q),[T11S-O$^\beta$-(Gly-Gly)],GLP(8-36)-CEX prodrug dissociated with a t$_{1/2}$=2.7 hrs to yield the parent drug (H7F),(E9Q),(T11S),GLP(8-36)-CEX along with the 2,5-diketopiperazine (DKP). The absolute potency of this prodrug was not determined because its half life is lower than the incubation period of the prodrug in the cell culture based luciferase assay (5 hrs). The half life of the prodrug (2.7 hrs) indicates that approximately 70% of the prodrug would have converted to the active entity in 5 hours; hence the assay could not be accurately performed on this prodrug. However, the ability to convert the internal serine prodrug to the active entity has been established.

Since the conditions for the conversion of the prodrugs to the drug (pH=7.2 and temperature=37° C.) are virtually invariant physiologically, it was found that the prodrug chemistry that was established at the O-terminal end of GLP-1 could be used to cleave from an internal site as well.

Example 5

In the following example, amino acid positions are in accordance with wild-type, immature GLP-1 (SEQ ID NO: 667) and all peptides comprised a C-terminal amide group in place of the C-terminal carboxylate group.

Six groups of diabetes-induced obesity (DIO) mice (eight mice per group) having an initial average body weight of 49.5 g were intraperitoneally injected with 2 nmol/kg of a PBS vehicle control or one of Peptides A-E described below:

Peptide A (also termed herein as "Peptide B (dF,dF)") is a prodrug of a GLP-1-based peptide in which the prodrug dipeptide moiety (d-Phe-dPhe) is attached to a bioactive GLP-1 peptide named Peptide B via the O-terminus. Peptide A has the amino acid sequence of SEQ ID NO: 645.

Peptide B (also termed herein as "HO-Phe7, Glu22 GLP-Cex") is the non-prodrug form of the GLP-1-based peptide of Peptides A and C. Peptide B has the amino acid sequence of SEQ ID NO: 646 and differs from native GLP-1 (SEQ ID NO: 667) in that His at position 7 is replaced with phenyl lactic acid (PLA), Ala at position 8 is replaced with AIB, Gly at position 22 is replaced with Glu, and the C-terminus is extended by nine amino acids with C-terminal amino acids of Exendin 4.

Peptide C (also termed herein as "Peptide B (dF,dV)") is a second prodrug form of the GLP-1-based peptide of Peptide B in which the prodrug dipeptide moiety (d-Phe-d-Val) is attached to the bioactive GLP-1 peptide via the 0-terminus. Peptide C has the amino acid sequence of SEQ ID NO: 647.

Peptide D (also termed herein as "Ser11, Glu22 GLP-Cex") is a GLP-1-based peptide which differs from native GLP-1 (SEQ ID NO: 667) in that Thr at position 11 is replaced with Ser, Ala at position 8 is replaced with AIB, Gly at position 22 is replaced with Glu, and the C-terminus is extended by nine amino acids with C-terminal amino acids of Exendin 4. Peptide D has the amino acid sequence of SEQ ID NO: 648.

Peptide E (also termed herein as "Peptide D Ser11(dF,dV)") is a prodrug of Peptide D in which the prodrug dipeptide moiety (d-Phe-d-Val) is attached to the bioactive GLP-1 peptide via an ester bond formed between the hydroxyl group of Ser at position 11 and the carboxylate group of d-Val. Peptide E has the amino acid sequence of SEQ ID NO: 649.

Fifteen minutes after injection with one of the compounds or with vehicle control (at time point 0), a 25% (w/v) glucose saline solution was injected at a dose of 1.5 g per kg of body weight. Blood glucose concentrations of the mice were measured at the time of injection of the compound or vehicle control, at the time of glucose injection, and at 15, 30, 60, and 120 minutes after glucose injection.

Figure 12:
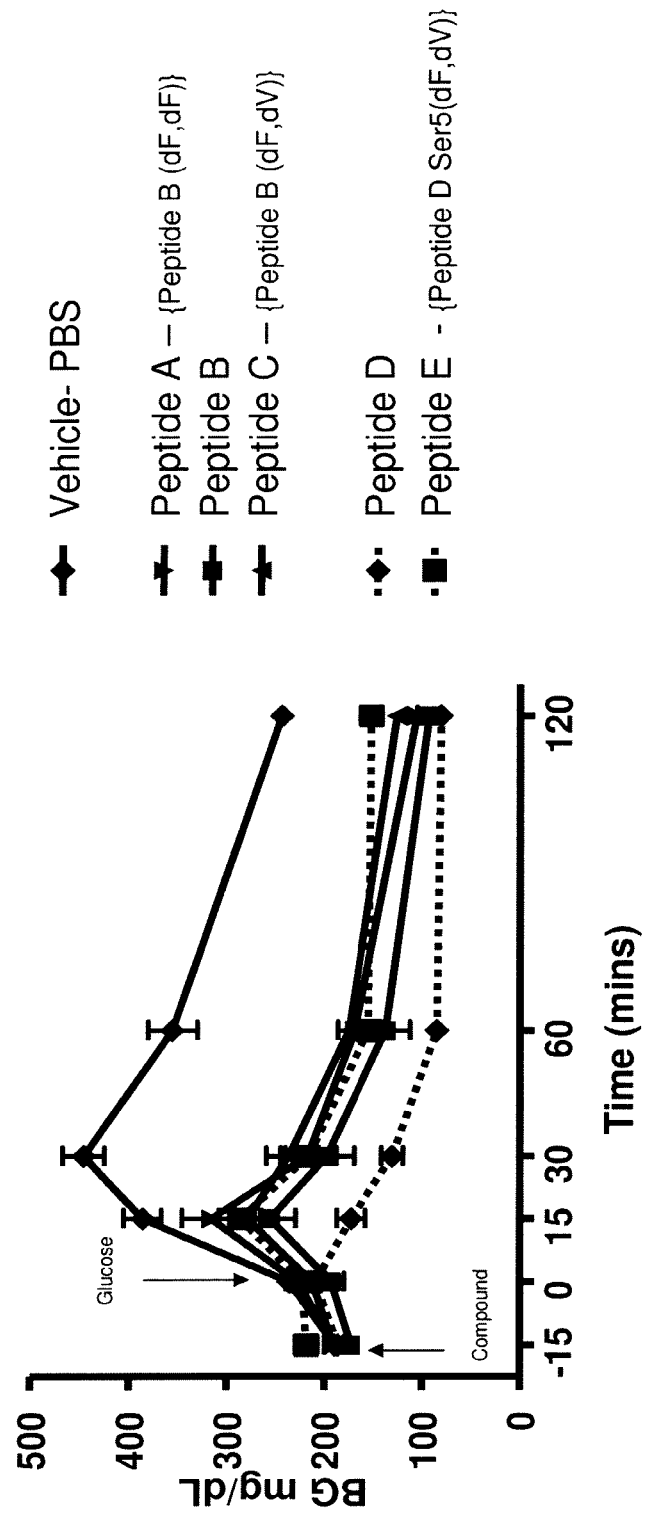
FIG. 12 represents a graph of blood glucose (mg/dl) as a function of time (minutes) in response to a glucose injection in DIO mice followed by injection with PBS vehicle, a GLP- 1-based peptide (Peptide B or D at 2 nmol/kg), or a prodrug of two different GLP-1-based peptides (Peptide A, C, or E at 2 nmol/kg).

As shown in FIG. 12, blood glucose concentration after injection with glucose in any group given one of Peptides A-E, did not rise as compared to the blood glucose levels after injection with glucose in mice injected with the vehicle control. The blood glucose concentration of mice injected with the prodrug forms of Peptides B and D (i.e., Peptides A, C, and E) were higher than the blood glucose levels of mice injected with the corresponding non-prodrug forms of the peptides, demonstrating the ability of the dipeptide prodrug moiety to prevent the compound from maximal binding to the GLP-1 receptor. The prodrug differential effect was greater when the prodrug dipeptide moiety was attached to the side chain of the amino acid at position 11, as compared to the effect seen when the prodrug was attached to the N-terminus of the GLP-1-based peptide.

Example 6

In the following example, amino acid positions are in accordance with wild-type, immature GLP-1 (SEQ ID NO: 667) and all peptides comprised a C-terminal amide group in place of the C-terminal carboxylate group.

The experiment described in Example 5 was repeated, except that mice were injected with 2 nmol/kg of a PBS vehicle control or one of Peptides F-H described below:

Peptide F (also termed herein as "desNH2-His7, Ser8, Glu22 GLP-Cex") is a GLP-1-based peptide which differs from native GLP-1 (SEQ ID NO: 667) in that His at position 7 is replaced with desamino-His, Ala at position 8 is replaced with Ser, Gly at position 22 is replaced with Glu, and the C-terminus is extended by nine amino acids with C-terminal amino acids of Exendin 4. Peptide F has the amino acid sequence of SEQ ID NO: 650.

Peptide G (also termed herein as "Peptide F-Ser2(dF,dV)") is a prodrug of Peptide F in which the prodrug dipeptide moiety (d-Phe-dVal) is attached to Peptide F via an ester bond formed between the hydroxyl group of the Ser at position 2 of Peptide F and the carboxylate group of d-Val. Peptide G has the amino acid sequence of SEQ ID NO: 651.

Peptide H (also termed herein as "Peptide X-Ser2(dF,dV)") is a prodrug of a GLP-1-based peptide termed herein as Peptide X (His7, Ser8, Glu22 GLP-Cex). Peptide X differs from native GLP-1 (SEQ ID NO: 667) in that Ala at position 8 is replaced with Ser, Gly at position 22 is replaced with Glu, and the C-terminus is extended by nine amino acids with C-terminal amino acids of Exendin 4. The prodrug dipeptide moiety of Peptide H (dPhe-dVal) is attached to Peptide X via an ester bond formed between the hydroxyl group of Ser at position 2 of Peptide X and the carboxylate group of d-Val. Peptide H has the amino acid sequence of SEQ ID NO: 652.

Figure 13:
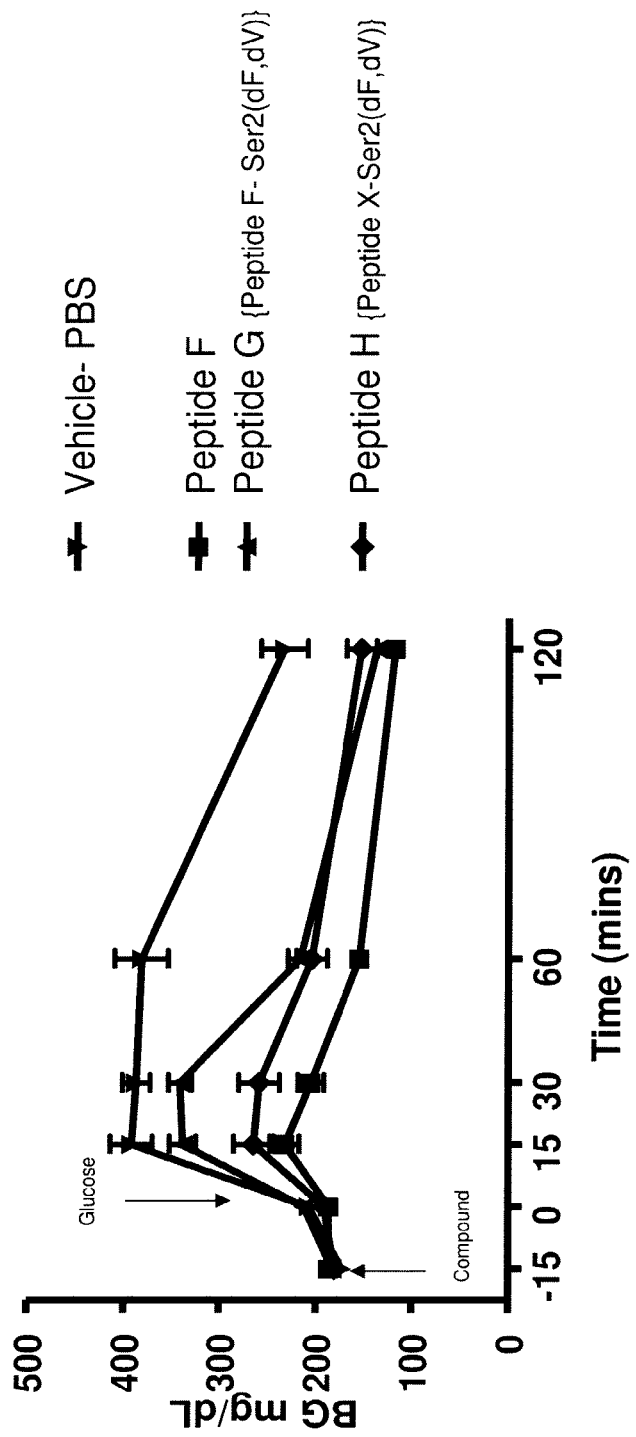
FIG. 13 represents a graph of blood glucose (mg/dl) as a function of time (minutes) in response to a glucose injection of DIO mice followed by injection with PBS vehicle, a GLP-1-based peptide (Peptide F at 2 nmol/kg), or a prodrug of two different GLP-1-based peptide (Peptide G or H at 2 nmol/kg).

Blood glucose levels of the mice were measured as described in Example 5. As shown in FIG. 13, Peptides F-H suppressed the rise in blood glucose in mice upon injection with glucose. The blood glucose levels of mice injected with the prodrug forms of Peptide F (i.e., Peptide G) were higher than the blood glucose levels of mice injected with its corresponding non-prodrug form, demonstrating the ability of the dipeptide prodrug moiety to prevent the peptide from maximal binding to the GLP-1 receptor.

Example 7

In the following example, amino acid positions are in accordance with wild-type, immature GLP-1 (SEQ ID NO: 667) and all peptides comprised a C-terminal amide group in place of the C-terminal carboxylate group.

Figure 14:
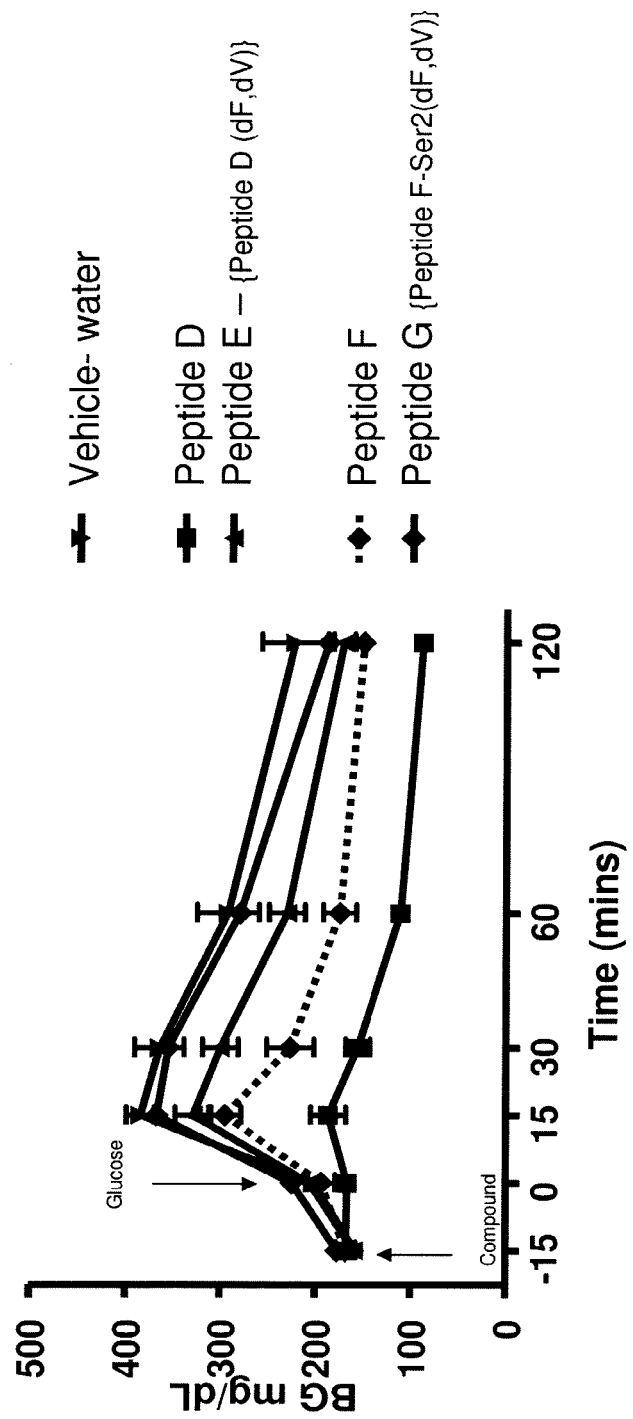
FIG. 14 represents a graph of blood glucose (mg/dl) as a function of time (minutes) in response to a glucose injection of DIO mice followed by an injection with PBS vehicle, a GLP-1-based peptide (Peptide D or F at 0.67 nmol/kg), or a prodrug of a GLP-1-based peptide (Peptide E or G at 0.67 nmol/kg).

The experiment described in Example 5 was repeated, except that mice were injected with 0.67 nmol/kg of a water vehicle control or one of Peptides D, E, F, and G as described in Examples 5 and 6. Blood glucose levels of the mice were measured as described in Example 5. As shown in FIG. 14, mice injected with the prodrug forms of the GLP-1-based peptides exhibited a higher blood glucose level upon injection with glucose as compared to the blood glucose levels of mice injected with the corresponding non-prodrug forms. These data demonstrate the ability of the prodrug moiety to prevent the GLP-1-based peptide from maximal binding to the GLP-1 receptor.

Example 8

In the following example, amino acid positions are in accordance with wild-type, immature GLP-1 (SEQ ID NO: 667) and all peptides comprised a C-terminal amide group in place of the C-terminal carboxylate group.

Nine groups of diabetes-induced obesity (DIO) mice (8 mice per group) having an initial average body weight of 56 g were intraperitoneally injected once and followed for one week with 15 or 70 nmol/kg of Peptides Y, Z, F-Peg, and G-Peg described below or PBS vehicle control.

Peptide Y (also termed herein as "Aib8, Glu22 GLP-Cex 40 kPeg") is a GLP-1-based peptide which differs from native GLP-1 (SEQ ID NO: 667) in that Ala at position 8 is replaced with AIB, Gly at position 22 is replaced with Glu, Ala at position 30 is replaced with Cys covalently linked to a 40 kDa PEG, and the C-terminus is extended by nine amino acids with C-terminal amino acids of Exendin 4. Peptide Y has the amino acid sequence of SEQ ID NO: 653.

Peptide Z (also termed herein as "GLP Aib8, Ser11 (dF, dV) Glu22 GLP-Cex 40 kPeg") is a prodrug of a GLP-1-based peptide which differs from native GLP-1 (SEQ ID NO: 667) in that Ala at position 8 is replaced with AIB, Thr at position 11 is replaced with Ser, Gly at position 22 is replaced with Glu, Ala at position 30 is replaced with Cys covalently linked to a 40 kDa PEG, and the C-terminus is extended by nine amino acids with C-terminal amino acids of Exendin 4. The prodrug dipeptide moiety of Peptide Z (d-Phe-d-Val) is attached to the GLP-1 based peptide via an ester bond formed between the hydroxyl group of the Ser at position 11 (according to the numbering of SEQ ID NO: 667) and the carboxylate of d-Val. Peptide Z has the amino acid sequence of SEQ ID NO: 654.

Peptide F-Peg (also termed herein as "GLP des-NH2His7, Ser8, Glu22-Cex 40 kPeg") is a GLP-1-based peptide which differs from native GLP-1 (SEQ ID NO: 667) in that His at position 7 is replaced with desamino-His, Ala at position 8 is replaced with Ser, Gly at position 22 is replaced with Glu, Ala at position 30 is replaced with Cys covalently linked to a 40 kDa PEG, and the C-terminus is extended by nine amino acids with C-terminal amino acids of Exendin 4. Peptide F-Peg has the amino acid sequence of SEQ ID NO: 655.

Peptide G-Peg (named "GLP des-NH$_2$His7, Ser8(dFdV), Glu22-Cex 40 kPeg") is a prodrug of Peptide F in which the prodrug dipeptide moiety (d-Phe-d-Val) is attached via an ester bond formed between the hydroxyl group of the Ser at position 8 and the carboxylate of d-Val. Peptide G-Peg has the amino acid sequence of SEQ ID NO: 656.

Sixty minutes after injection with one of the peptides or with vehicle control (at time point 0), a 25% (w/v) glucose saline solution was injected at a dose of 1.5 g per kg of body weight. Blood glucose concentrations of the mice were measured at the time of injection of the peptide or vehicle control (at time point −60), at the time of glucose injection (at time point 0), and at 15, 30, 60, and 120 minutes after glucose injection.

Figure 15:
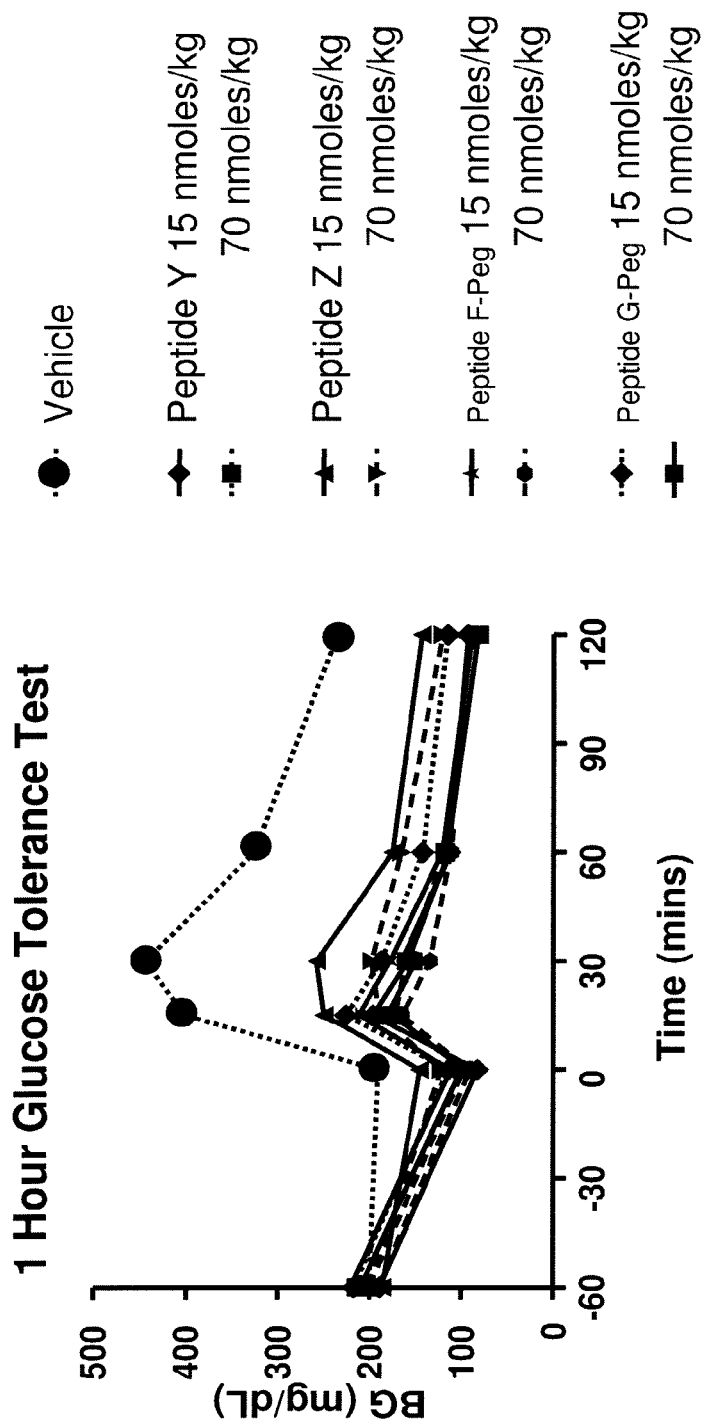
FIG. 15 represents a graph of blood glucose (mg/dl) as a function of time (minutes) in response to a glucose injection of DIO mice injected followed by an injection with vehicle control, a GLP-1-based pegylated peptide at 15 or 70 nmol/kg (Peptides Y and F-Peg), or a prodrug of a GLP-1-based peptide at 15 or 70 nmol/kg (Peptides Z and G-Peg).
Figure 16:
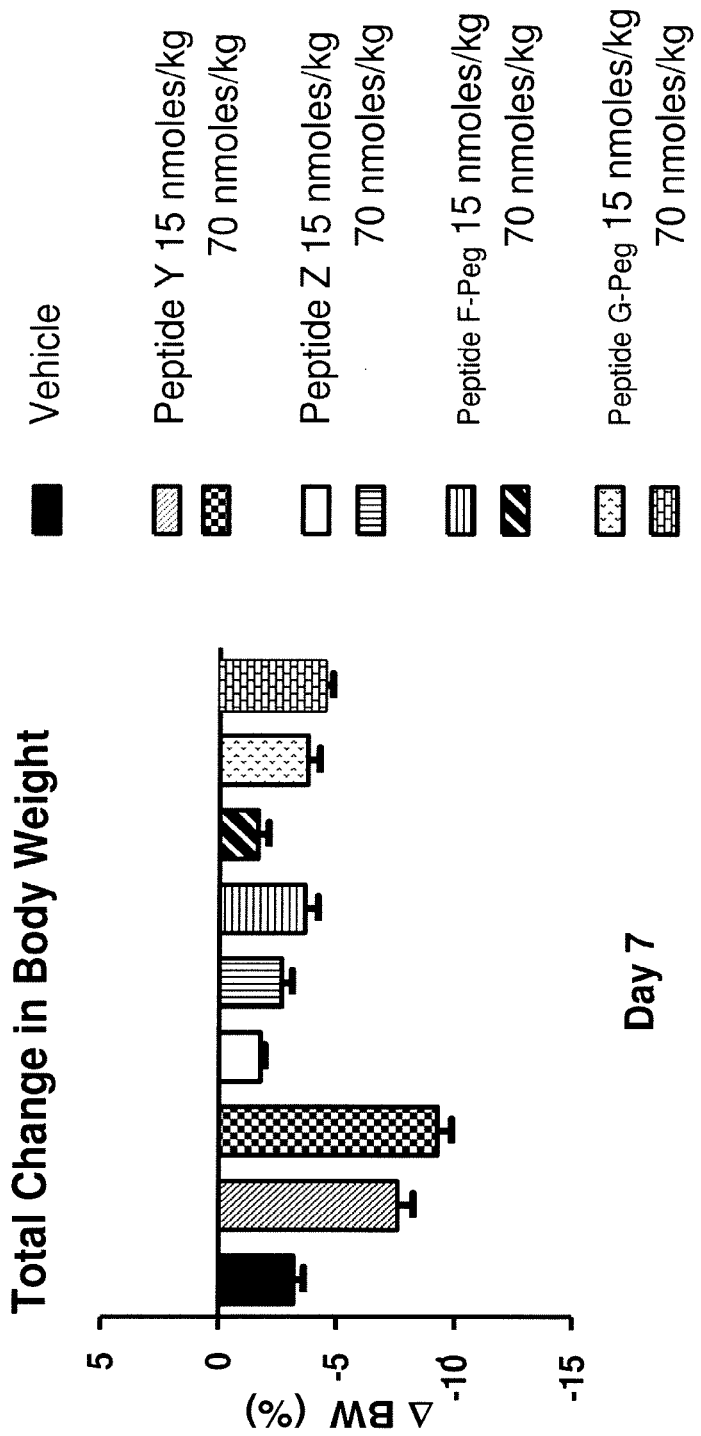
FIG. 16 represents a graph of the total change in body weight of DIO mice injected with vehicle control, a GLP-1-based pegylated peptide at 15 or 70 nmol/kg (Peptides Y and F-Peg), or a prodrug of a GLP-1-based peptide at 15 or 70 nmol/kg (Peptides Z and G-Peg).

As shown in FIG. 15, the blood glucose concentrations of the group of mice injected with any of Peptides Y, Z, F-Peg, G-Peg were less as compared to the blood glucose levels of mice injected with vehicle control.

The body weight of each mouse of each group was measured on 1, 3, 5, and 7 days after injection with the vehicle control or peptide. Total change in body weight was calculated by subtracting the average body weight of a group at the time of injection with vehicle or peptide from the average body weight of the group seven days after injection. Food intake by each group of mice was measured during the course of the week as well. Total food intake was measured seven days after injection with vehicle control or peptide. As shown in FIG. 17, the total food intake was decreased in all groups of mice injected with one of Peptides Y, Z, F-Peg, G-Peg. Peptide Y appeared to be the most potent of the four peptides in decreasing appetite and decreasing body weight. This result is a function of the native amino acid sequence. The Ser11 substitution or the des-amino His7 reduces total efficacy. Importantly, Peptides F-Peg and G-Peg perform similarly and demonstrate that when only the ester-prodrug is introduced the total efficacy as measured over a week study is comparable.

Example 9

The following assays are used to test the solubility, receptor binding activity, and stability of the bioactive peptides.

Glucagon Solubility Assays:

A solution (1 mg/ml or 3 mg/ml) of glucagon (or an analog) is prepared in 0.01N HCl. 100 μl of stock solution is diluted to 1 ml with 0.01N HCl and the UV absorbance (276 nm) is determined. The pH of the remaining stock solution is adjusted to pH 7 using 200-250 μl 0.1M $Na_2HPO_4$ (pH 9.2). The solution is allowed to stand overnight at 4° C. then centrifuged. 100 μl of supernatant is then diluted to 1 ml with 0.01N HCl, and the UV absorbance is determined (in duplicate).

The initial absorbance reading is compensated for the increase in volume and the following calculation is used to establish percent solubility:

$$\frac{\text{Final Absorbance}}{\text{Initial Absorbance}} \times 100 = \text{percent soluble}$$

Glucagon Receptor Binding Assay

The affinity of peptides to the glucagon receptor is measured in a competition binding assay utilizing scintillation proximity assay technology. Serial 3-fold dilutions of the peptides made in scintillation proximity assay buffer (0.05 M Tris-HCl, pH 7.5, 0.15 M NaCl, 0.1% w/v bovine serum albumin) are mixed in 96 well white/clear bottom plate (Corning Inc., Acton, Mass.) with 0.05 nM (3-[$^{125}$I]-iodotyrosyl) Tyr10 glucagon (Amersham Biosciences, Piscataway, N.J.), 1-6 micrograms per well, plasma membrane fragments prepared from cells over-expressing human glucagon receptor, and 1 mg/well polyethyleneimine-treated wheat germ agglutinin type A scintillation proximity assay beads (Amersham Biosciences, Piscataway, N.J.). Upon 5 min shaking at 800 rpm on a rotary shaker, the plate is incubated 12 h at room temperature and then read on MicroBeta1450 liquid scintillation counter (Perkin-Elmer, Wellesley, Mass.). Non-specifically bound (NSB) radioactivity is measured in the wells with 4 times greater concentration of "cold" native ligand than the highest concentration in test samples and total bound radioactivity was detected in the wells with no competitor. Percent specific binding is calculated as following: % Specific Binding=((Bound−NSB)/(Total bound−NSB))×100. $IC_{50}$ values are determined by using Origin software (OriginLab, Northampton, Mass.).

Stability Assay for Glucagon Analogs

Each glucagon analog is dissolved in water or PBS and an initial HPLC analysis is conducted. After adjusting the pH (4, 5, 6, 7), the samples are incubated over a specified time period at 37° C. and re-analyzed by HPLC to determine the integrity of the peptide. The concentration of the specific peptide of interest is determined and the percent remaining intact is calculated relative to the initial analysis.

Example 10

Names of glucagon related analog peptides are to be read as follows: the range indicated in parentheses following the word "glucagon" indicates the amino acids of glucagon present in the peptide, wherein an amino acid substitution for the native amino acid of glucagon is indicated by the presence of an amino acid followed by a number (e.g., PLA6, E9, Glu9, etc.) before the word "glucagon." The numbers following an amino acid (e.g., the "6" of "PLA6") designates the amino acid position in accordance with the numbering of native glucagon (SEQ ID NO: 612).

The following procedures are used to make a variety of glucagon related analog peptides.

Synthesis of [PLA6, E9]Glucagon(6-29) Amide

A peptide sequence TSEYSKYLDSRRAQD-FVQWLMNT (SEQ ID NO: 951; [E3]glucagon(7-29)) was first solid phase synthesized on ABI 433A automated peptide synthesizer using 0.1 mmole Fmoc/HOBT/DCC chemistry program with 0.1 mmole Rink MBHA amide resin using DIC/HOBT as coupling reagent. The following Fmoc amino acid were used: Ala, Arg(Pmc), Asp(OtBu), Asn(Trt), Glu (OtBu), Gln(Trt), Leu, Lys(Boc), Met, PLA, Ser(tBu), Thr (tBu), Trp(Boc), Tyr(tBu), and Val.

After the automated synthesis, the peptidyl resin was coupled manually with 3-phenyllactic acid (83 mg, 0.5 mmole) and DEPBT (150 mg, 0.5 mmole) in 4 ml 5% DIEA/DMF for about 2 h to obtain the peptidyl resin with the following sequence: HO-PLA-Thr-Ser-Glu-Tyr-Ser-Lys-Tyr-Leu-Asp-Ser-Arg-Arg-Ala-Gln-Asp-Phe-Val-Gln-Trp-Leu-Met-Asn-Thr-NH, (SEQ ID NO: 950).

Peptidyl resin was treated with 8.5 ml TFA with addition of 0.5 g phenol, 0.5 ml water and 0.5 ml thioanisole at room temperature for about 2 hs. The peptide dissolved in TFA was filtered and 40 ml ether was added to precipitate the peptide. The crude peptide were centrifuged, dissolved in aqueous acetic acid and lyophilized. Crude peptide yield was 200~250 mg and after purification the yield was 25~40 mg (10~15% yield totally) peptide with 95% purity. The peptide was analyzed in general analytical HPLC showing retention time as 7.66 min and ESI-MS analysis demonstrated the desired mass of 2986.0 corresponding with the peptide molecular weight 2986.3.

A similar procedure was used to synthesize the peptide [PLA6, D9]glucagon(6-29) amide with analytical HPLC 7.25 min and ESI-MS 2973.5 corresponding to the calculated MW 2973.3; [PLA6, D9, D28]glucagon(6-29) amide with analytical HPLC 7.46 min and ESI-MS 2973.0 corresponding the calculated MW 2973.3; [PLA6, C8, E9]glucagon(6-29) amide with analytical HPLC 7.20 min and ESI-MS 3002.0 corresponding the calculated MW 3002.3; [PLA6, E9, C16] glucagon(6-29) amide with analytical HPLC 7.38 min and ESI-MS 3002.0 corresponding the calculated MW 3002.3; [PLA6, E9, C24]glucagon(6-29) amide with analytical HPLC 7.33 min and ESI-MS 2961.0 corresponding the calculated MW 2961.3; [PLA6, D9, C24]glucagon(6-29) amide with analytical HPLC 7.43 min and ESI-MS 2947.0 corresponding the calculated MW 2947.3; [PLA6, E9, C40]glucagon(6-40) amide with analytical HPLC 7.28 min and MALDI-MS 3925.5 corresponding the calculated MW 3924.3.

Synthesis of [hCys(SO3H)9]Glucagon (6-29) Amide

A peptide sequence YSKYLDSRRAQDFVQWLMNT (SEQ ID NO: 951; glucagon(10-29)) was first solid phase synthesized on ABI 433A automated peptide synthesizer using 0.1 mmole Fmoc/HOBT/DCC chemistry program with 0.1 mmole Rink MBHA amide resin using DIC/HOBT as coupling reagent.

After the automated synthesis, the peptidyl resin was coupled manually with Fmoc-homoCys(SO3Na)—OH (130 mg, 0.3 mmole), HOBT (45.2 mg, 0.33 mole) and DIC (52.0 ul, 0.33 mole) in 4 ml DMF for about 2 h. After the ninhydrin test, half potion of the peptidyl resin (0.05 mmole) was further assembled automatically with the remain 3 amino acid Ser, Thr and Phe to obtain the peptidyl resin with the following sequence: $H_2$N-Phe-Thr-Ser-homoCys(SO3H)-Tyr-Ser-Lys-Tyr-Leu-Asp-Ser-Arg-Arg-Ala-Gln-Asp-Phe-Val-Gln-Trp-Leu-Met-Asn-Thr-NH2 (SEQ ID NO: 952).

The following Fmoc amino acid were used: Ala, Arg(Pmc), Asp(OtBu), Asn(Trt), Gln(Trt), homoCys(SO3Na), Leu, Lys (Boc), Met, Phe, Ser(tBu), Thr(tBu), Trp(Boc), Tyr(tBu), and Val.

Peptidyl resin was treated with 8.5 ml TFA with addition of 0.5 g phenol, 0.5 ml water and 0.5 ml thioanisole at room temperature for about 2 hs. The peptide dissolved in TFA was filtered and 40 ml ether was added to precipitate the peptide. The crude peptides were centrifuged, dissolved in aqueous acetic acid and lyophilized. Crude peptide yield was 100~130 mg, and after purification 15~20 mg (10~15% yield totally) peptide was obtained with 95% purity. The peptide was analyzed in general analytical HPLC shown retention time as 6.73 min and ESI-MS analysis demonstrated the desired mass of 3021.0 corresponding with the peptide molecular weight 3021.3.

Similar procedure to synthesize the [hCys(SO3H)9]glucagon (5-29) amide with analytical HPLC retention time 6.82 min and ESI-MS 3122.5 corresponding the calculated MW 3122.4; [hCys(SO3H)9]glucagon (4-29) amide with analytical HPLC retention time 6.83 min and ESI-MS 3178.5 corresponding the calculated MW 3179.3; [hCys(SO3H)9]glucagon (2-29) amide with analytical HPLC retention time 6.79 min and ESI-MS 3394.5 corresponding the calculated MW 3394.7; [PLA6, hCys(SO3H)9]glucagon (6-29) amide with analytical HPLC retention time 7.17 min and ESI-MS 3022.0 corresponding the calculated MW 3022.3.

Synthesis of [PLA6, E9, C24(1.2K)]Glucagon (6-29) Amide 20 mg (0.00675 mmole) [PLA6, E9, C24]glucagon (6-29) amide and 12.5 mg (0.01 mmole) m-dPEGTM24-MAL(MW 1239, Quanta biodesign Ltd. Powell, Ohio) were dissolved in 9 ml 25% acetonitrile water and 1 ml 1M Tris base buffer (adjust pH to 8.0~8.5). The reaction was stirred at room temperature and the progress of the reaction was monitored by analytical HPLC. After no initial product was detected on HPLC (about after 2 hrs), the reaction mixture was directly purified by preparative HPLC.

After lyophilized, about 10~12 mg [PLA6, E9, C24(1.2K)] glucagon (6-29) amide was obtained which analytical HPLC analysis shown retention time as 7.48 min and ESI-MS 4218.5 corresponding the calculated [M+H2O] 4218.0.

A similar procedure was used to synthesize the [C5(1.2K), E9]glucagon (5-29) amide which analytical HPLC analysis shown retention time as 7.25 min and ESI-MS 4327.5 corresponding the calculated MW 4327.8; [C8(1.2K), E9]glucagon (6-29) amide which analytical HPLC analysis shown retention time as 7.25 min and ESI-MS 4260.0 corresponding the calculated [M+$H_2$O] 4259.0

Synthesis of [PLA6, E9, C24(20K)]Glucagon (6-29) Amide 15 mg (0.005 mmole) [PLA6, E9, C24]glucagon (6-29) amide and 140 mg (0.006 mmole) 20K mPEG-MAL (MW~22k, Nektar, Huntsville, Ala.) were dissolved in 9 ml 25% acetonitrile water and 1 ml 1M Tris base buffer (adjust pH to 8.0~8.5). The reaction was stirred at room temperature and the progress of the reaction was monitored by analytical HPLC. After no initial product was detected on HPLC (about after 6 hrs), the reaction mixture was directly purified by preparative HPLC. The fractions were checked by analytical HPLC at 214 nm and also measured by UV at 280 nm. The fractions with 90% HPLC purity and also with high absorption (A280 nm=1.0~2.0) in UV measurement were combined and lyophilized. About 60~80 mg [PLA6, E9, C24(20K)] glucagon (6-29) amide can be obtained which analytical HPLC analysis shown retention time as 8.5~8.6 min and MALDI-MS shown broad mass spectrometry at 24K~26K.

A similar procedure was used to synthesize [PLA6, C8(20K), E9]glucagon (6-29) amide, [PLA6, E9, C16(20 kDa)]glucagon (6-29) amide, [PLA6, E9, C40(20K)]glucagon (6-40) amide, [PLA6, D9, C16(20 kDa)]glucagon (6-29) amide and [PLA6, D9, C24(20K)]glucagon (6-29) amide.

Synthesis of [PLA6, E9, C24(40 kDa)]Glucagon (6-29) Amide 15 mg (0.005 mmole) [PLA6, E9, C24]glucagon (6-29) amide and 240 mg (0.006 mmole) 40K mPEG-MAL (MW~40k, Chirotech Technology Ltd., Cambs CB4 OWG, German) were dissolved in 18 ml 25% acetonitrile water and 2 ml 1M Tris base buffer (adjust pH to 8.0~8.5). The reaction was stirred at room temperature and the progress of the reaction was monitored by analytical HPLC. After no initial product was detected on HPLC (about after 6 hrs), the reaction mixture was directly purified by preparative HPLC. The fractions were checked by analytical HPLC at 214 nm and also measured by UV at 280 nm. The fractions with 90% HPLC purity and also with high absorption (A280 nm=1.0~2.0) in UV measurement were combined and lyophilized. About 100~120 mg [PLA6, E9, C24(40K)]glucagon (6-29) amide can be obtained which analytical HPLC analysis shown retention time as 8.60~8.8 min.

A similar procedure was used to synthesize [PLA6, C8(40K), E9]glucagon (6-29) amide, [PLA6, E9, C16(40K)] glucagon (6-29) amide and [PLA6, E9, C40(40K)]glucagon (6-40) amide, [PLA6, D9, C16(40K)]glucagon (6-29) amide and [PLA6, D9, C24(40K)]glucagon (6-29) amide.

Synthesis of Dimer[PLA6, E9, C24]Glucagon (6-29) Amide 20 mg (0.00675 mmole) [PLA6, E9, C24]glucagon (6-29) amide was dissolved in 6 ml PBS buffer, 1 ml 1M Tris base (adjust pH 8.0~8.5) and 3 ml DMSO. The reaction mixture was stirred in an open air container and monitored by analytical HPLC every 2 hr. After the initial product (HPLC RT 7.4 min) was gone and the dimer product (HPLC RT 7.9 min) was the dominate product (after 12 hr), the mixture was diluted with 0.1% TFA10% acetonitrile water and directly purified by preparative HPLC. After lyophilized about 6-8 mg Dimer [PLA6, E9, C24]glucagon (6-29) amide was obtained with ESI-MS 5920.0 corresponding the calculated MW 5920.6.

A similar procedure was used to synthesize the Dimer[C9] glucagon(6-29) amide with ESI-MS 5916.0 corresponding the calculated MW 5916.6 and Dimer[C5, E9]glucagon(5-29) amide with ESI-MS 6174.0 corresponding the calculated MW 6174.8.

Acylated and/or PEGylated Peptides are Prepared as Follows.

Peptides are synthesized on a solid support resin using either a CS Bio 4886 Peptide Synthesizer or Applied Biosystems 430A Peptide Synthesizer. In situ neutralization chemistry is used as described by Schnolzer et al., Mt. *J. Peptide Protein Res.* 40: 180-193 (1992). For acylated peptides, the target amino acid residue to be acylated (e.g., position ten) is substituted with an N ε-FMOC lysine residue. Treatment of the completed N-terminally BOC protected peptide with 20% piperidine in DMF for 30 minutes removes FMOC/formyl groups. Coupling to the free ε-amino Lys residue is achieved by coupling a ten-fold molar excess of either an FMOC-protected spacer amino acid (ex. FMOC-(N-BOC)-Tryptophan-OH) or acyl chain (ex. C17-COOH) and PyBOP or DEPBT coupling reagent in DMF/DIEA. Subsequent removal of the spacer amino acid's FMOC group is followed by repetition of coupling with an acyl chain. Final treatment with 100% TFA results in removal of any side chain protecting groups and the N-terminal BOC group. Peptide resins are neutralized with 5% DIEA/DMF, dried, and then cleaved from the support using HF/p-cresol, 95:5, at 0° C. for one hour. Following ether extraction, a 5% HOAc solution is used to solvate the crude peptide. A sample of the solution is then verified to contain the correct molecular weight peptide by ESI-MS. Correct peptides are purified by RP-HPLC using a linear gradient of 10% CH3CN/0.1% TFA to 0.1% TFA in 100% CH3CN. A Vydac C18 22 mm×250 mm protein column is used for the purification. Acylated peptide analogs generally complete elution by a buffer ratio of 20:80. Portions are pooled together and checked for purity on an analytical RP-HPLC. Pure fractions are lyophilized yielding white, solid peptides.

If a peptide comprises a lactam bridge and target residues to be acylated, acylation is carried out as described above upon addition of that amino acid to the peptide backbone.

For peptide pegylation, 40 kDa methoxy poly(ethylene glycol) maleimido-propionamide (Chirotech Technology Ltd.) is reacted with a molar equivalent of peptide in 7M Urea, 50 mM Tris-HCl buffer using the minimal amount of solvent needed to dissolve both peptide and PEG into a clear solution (generally less than 2 mL for a reaction using 2-3 mg peptide). Vigorous stirring at room temperature is commenced for 4-6 hours and the reaction is analyzed by analytical RP-HPLC. PEGylated products appear distinct from the starting material with decreased retention times. Purification is performed on a Vydac C4 column with conditions similar to those used for the initial peptide purification. Elution occurs around buffer ratios of 50:50. Fractions of pure PEGylated peptide are found and lyophilized.

Synthesis of Cholesterolylated Peptides

The cholesterol-modified peptides were prepared by conjugating lactamized peptides with a bromoacetylated cholesterol derivative in solution. The peptides were assembled using conventional solid-phase peptide synthesis (SPPS). The PLA derivatized peptide chain was cylized via a lactam bridge. The standard cleavage procedure and purification method were applied to obtain the desired depsipeptide.

Example

Synthesis of Cholesterol Conjugated Lactam-Bridge Peptide [PLA6, K10(COCH2CH2S-Chol), E16K20(lactam), D28]G(6-29) Amide A peptidyl resin with sequence HO-PLA-TSDKSKY-LDERRAKDFVQWLMDT [PLA6, K10, E16, K20, D28] glucagon(6-29) was synthesized by solid-phase Boc-chemistry using an ABI 430A automated peptide synthesizer with 0.2 mmole MBHA amide resin and DEPBT as coupling reagent. The following Boc amino acids were used: Ala, Arg(Tos), Asp(OcHx), Asn(Xan), Glu(OcHx), Gln(Xan), Leu, Lys(2-Cl-Z), Met, PLA, Ser(OBzl), Thr(OBzl), Trp (CHO), Tyr(2.6-di-Cl-Bzl) and Val except the glutamic acid at position 16 was incorporated with Boc-Glu(OFm)—OH, lysine at position 20 was incorporated with Boc-Lys(Fmoc)-OH and lysine at position 10 was incorporated with Boc-Lys (Alloc)-OH. After removal of Fm and Fmoc protecting groups at positions 16 and 20 with 20% piperidine in DMF, the peptidyl resin was treated with 300 mg (1 mmol)DEPBT in 10% DIEA/DMF for about 4 h to form the lactam bridge. This lactam-bridged peptidyl resin was treated a solution composed of 100 mg (0.4 equiv.) Pd(PPh$_3$)$_4$, 120 uL PhSiH$_3$, 0.25 mL N-methylmorpholine and 0.5 mL acetic acid in 10 mL CHCl$_3$ under N$_2$ atmosphere for about 3 h to remove the Alloc group. The 3-tritylthiopropionic acid was then coupled by DEPBT to obtain the peptidyl resin with a sequence of: HO-PLA-Thr-Ser-Asp-Lys(COCH$_2$CH$_2$SH)-Ser-Lys-Tyr-Leu-Asp-Glu*-Arg-Arg-Ala-Lys*-Asp-Phe-Val-Gln-Trp-Leu-Met-Asp-Thr-NH$_2$. (* are lactam bridged)

The peptidyl resin was treated with liquid hydrogen fluoride to cleave the crude peptide from the solid support and remove all protecting groups. The peptide was purified by preparative HPLC, and analyzed by MS and analytical RP-HPLC. The purified peptide demonstrated a single peak in analytical RP-HPLC and the ESI-MS analysis yielded the desired mass of 3050.7 which corresponds with the calculated molecular weight of 3051.0 daltons of the peptide [PLA6, K10(CH2CH2SH), E16K20(lactam), D28]G(6-29) amide.

To synthesize the cholesterol conjugated peptide [PLA6, K10(COCH2CH2S-Chol), E16K20(lactam), D28]G(6-29) amide, 10 mg (3.28 μM) of [PLA6, K10(COCH2CH2SH), E16K20(lactam), D28]G(6-29) amide was dissolved in 2 mL of 7 M urea buffer containing 50 mM Tris-HCl (pH 8.0). To this solution was added 10 mg (9 μM) of cholesterol reagent Br-Oxa$_{12}$-Chol (see the structure below), at room temperature. The reaction was monitored by HPLC. After about 4 h, the reaction solution was purified directly by HPLC. The purified cholesterol conjugated peptide demonstrated a single peak in analytical chromatography and the ESI-MS analysis yielded the desired mass of 4074.13 which corresponds with the calculated molecular weight of 4073.0 of the cholesterol conjugated lactam-bridge peptide [PLA6, K10 (COCH2CH2S-Chol), E16K20(lactam), D28]G(6-29) amide.

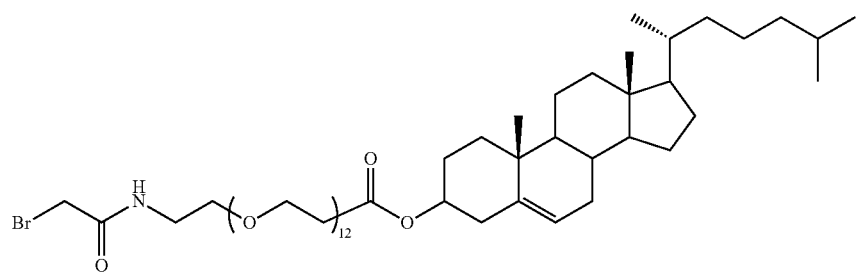

Br-Oxa$_{12}$-Chole

Similar procedures were used to synthesize the other cholesterol conjugated and lactam-bridged peptides such as [PLA6, E16K20(lactam), D28, K30(COCH2CH2S-Chol)]G (6-30) amide and [PLA6, E16K20(lactam), D28, K40 (COCH2CH2S-Chol)]G(6-40) amide reported in this patent. Synthesis of Glucagon-Based Depsipeptides [Thr5-O-PLA6, E9]Glucagon (2-29) Amide and [Thr5-O-PLA6, E9]Glucagon (1-29) Amide A peptide sequence HO-PLA-TSEYSKYLDSRRAQD-FVQWLMNT [PLA6, E9]glucagon(6-29) (SEQ ID NO: 971) was synthesized by solid-phase Boc-chemistry using an ABI 430A automated peptide synthesizer with 0.2 mmole MBHA amide resin and DEPBT as coupling reagent. The following Boc amino acids were used: Ala, Arg(Tos), Asp (OcHx), Asn(Xan), Glu(OcHx), Gln(Xan), Leu, Lys(2-Cl-Z), Met, PLA, Ser(OBzl), Thr(OBzl), Trp(HOC), Tyr(2,6-di-Cl-Bzl), and Val. To this peptide was formed a depsi-peptide (ester bond) on the resin through manual coupling with a pre-activated symmetrical anhydride solution composed of Boc-Thr(OBzl)-OH (2 mmole)/DIC (1 mmole)/DMAP (0.2 mmole) in DCM for about 16 h. The remaining amino acids were coupled by standard Boc-chemistry to obtain the depsipeptidyl resin of the following sequence: Ser-Gln-Gly-Thr-O-PLA-Thr-Ser-Glu-Tyr-Ser-Lys-Tyr-Leu-Asp-Ser-Arg-Arg-Ala-Gln-Asp-Phe-Val-Gln-Trp-Leu-Met-Asn-Thr-NH, (SEQ ID NO: 964).

The peptidyl resin was treated with liquid hydrogen fluoride to cleave the crude peptide from the solid support and remove all protecting groups. The depsipeptide was purified by preparative HPLC, and analyzed by MS and analytical HPLC. The purified peptide demonstrated a single peak in analytical chromatography and the ESI-MS analysis yielded the desired mass of 3359.0 which corresponds with the calculated molecular weight of 3359.6 daltons.

A similar procedure was used to synthesize the depsipeptide [Thr5-O-PLA6, E9]glucagon (1-29) amide (SEQ ID NO: 965) with a single addition coupling of an N-terminal histidine residue. The purified peptide demonstrated a single peak in analytical chromatography and the ESI-MS analysis yielded the desired mass of 3495.9 which corresponds with the calculated molecular weight of 3496.8 daltons.

SEQUENCE LISTING (1118 sequences)

SEQ ID NO: 1 - protein, 29 aa, Homo sapiens
HSQGTFTSDYSKYLDSRRAQDFVQWLMNT

SEQ ID NO: 2 - protein, 29 aa, Artificial Sequence
  Synthetic Glucagon Analogue
  MOD_RES (16)..(16): Glu, Gln, homoglutamic acid or homocysteic acid
  MOD_RES (17)..(17): Arg, Cys, Orn, homocysteine or acetyl phenylalanine
  MOD_RES (27)..(27): Met, Leu or Nle
HSQGTFTSDYSKYLDXXRAQDFVQWLXNT

SEQ ID NO: 3 - protein, 29 aa, Artificial Sequence
  Synthetic Glucagon Analogue
  MOD_RES (16)..(16): Glu, Gln, homoglutamic acid or homocysteic acid
  MOD_RES (21)..(21): Asp, Cys, Orn, homocysteine or acetyl phenyalanine
  MOD_RES (27)..(27): Met, Leu or Nle
HSQGTFTSDYSKYLDXRRAQXFVQWLXNT

SEQ ID NO: 4 - protein, 29 aa, Artificial Sequence
  Synthetic Glucagon Analogue
  MOD_RES (16)..(16): Glu, Gln, homoglutamic acid or homocysteic acid
  MOD_RES (24)..(24): Gln, Cys, Orn, homocysteine or acetyl phenylalanine
  MOD_RES (27)..(27): Met, Leu or Nle
HSQGTFTSDYSKYLDXRRAQDFVXWLXNT

SEQ ID NO: 5 - protein, 29 aa, Artificial Sequence
  Synthetic Glucagon Analogue
  MOD_RES (16)..(16): Glu, Gln, homoglutamic acid or homocysteic acid
  MOD_RES (21)..(21): Asp, Cys, Orn, homocysteine or acetyl phenyalanine
  MOD_RES (24)..(24): Gln, Cys, Orn, homocysteine or acetyl phenyalanine
  MOD_RES (27)..(27): Met, Leu or Nle
HSQGTFTSDYSKYLDXRRAQXFVXWLXNT

SEQ ID NO: 6 - protein, 29 aa, Artificial Sequence
  Synthetic Glucagon Analogue
  MOD_RES (21)..(21): Asp, Cys, Orn, homocysteine or acetyl phenyalanine
  MOD_RES (27)..(27): Met, Leu or Nle
HSQGTFTSDYSKYLDERRAQXFVQWLXNT

SEQ ID NO: 7 - protein, 29 aa, Artificial Sequence
  Synthetic Glucagon Analogue
  MOD_RES (24)..(24): Gln, Cys, Orn, homocysteine or acetyl phenylalanine
  MOD_RES (27)..(27): Met, Leu or Nle
HSQGTFTSDYSKYLDERRAQDFVXWLXNT

SEQ ID NO: 8 - protein, 29 aa, Artificial Sequence
  Synthetic Glucagon Analogue
  MOD_RES (16)..(16): Glu, Gln, homoglutamic acid or homocysteic acid
HSQGTFTSDYSKYLDXRRAQDFVQWLMNT

SEQ ID NO: 9 - protein, 29 aa, Artificial Sequence
  Synthetic Glucagon Analogue
  MOD_RES (27)..(27): Met, Leu or Nle
HSQGTFTSDYSKYLDERRAQDFVQWLXNT

SEQ ID NO: 10 - protein, 29 aa, Artificial Sequence
  Synthetic Glucagon Analogue
HSQGTFTSDYSKYLDERRAQDFVQWLMNT

SEQ ID NO: 11 - protein, 29 aa, Artificial Sequence
  Synthetic Glucagon Analogue
  MISC_FEATURE: c-term amidation
HSQGTFTSDYSKYLDERRAQDFVQWLMNT

SEQ ID NO: 12 - protein, 29 aa, Artificial Sequence
  Synthetic Glucagon Analogue
  MISC_FEATURE (12)..(16): lactam ring between side chains at position 12 and 16
HSQGTFTSDYSKYLDERRAQDFVQWLMNT

SEQ ID NO: 13 - protein, 29 aa, Artificial Sequence
  Synthetic Glucagon Analogue
  MISC_FEATURE: lactam ring between side chains at positions 16 and 20
HSQGTFTSDYSKYLDERRAKDFVQWLMNT

SEQ ID NO: 14 - protein, 29 aa, Artificial Sequence
  Synthetic Glucagon Analogue
  MISC_FEATURE: lactam ring between side chains at positions 22 and 24
HSQGTFTSDYSKYLDSRRAKDFVEWLMNT

SEQ ID NO: 15 - protein, 29 aa, Artificial Sequence
  Synthetic Glucagon Analogue
  MISC_FEATURE: lactam ring formed between side chains at positions 24 and 28
HSQGTFTSDYSKYLDSRRAQDFVEWLMKT

SEQ ID NO: 16 - protein, 29 aa, Artificial Sequence
  Synthetic Glucagon Analogue
  MISC_FEATURE: lactam ring between side chains at positions 12 and 16 as well as 20 and 24
HSQGTFTSDYSKYLDERRAKDFVEWLMNT

SEQ ID NO: 17 - protein, 29 aa, Artificial Sequence
  Synthetic Glucagon Analogue
  MISC_FEATURE: lactam ring between side chains at positions 16 and 20 as well as 24 and 28
HSQGTFTSDYSKYLDERRADDFVEWLMKT

SEQ ID NO: 18 - protein, 29 aa, Artificial Sequence
  Synthetic Glucagon Analogue
  MISC_FEATURE: Lactam ring formed between side chain of Glu at position 16 and Lys at position 20
HSQGTFTSDYSKYLDERRAKDFVEWLMKT

SEQ ID NO: 19 - protein, 30 aa, Artificial Sequence
  Synthetic Glucagon Analogue
  MISC_FEATURE: c-term amidation
  MOD_RES (30)..(30): Variable amino acid
HSQGTFTSDYSKYLDERRAQDFVQWLMNTX

SEQ ID NO: 20 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln, Lys, Arg, Orn or Citrulline
  MOD_RES (24)..(24): Gln or Glu
  MOD_RES (28)..(28): Asn, Asp or Lys
  MOD_RES (29)..(29): Thr or Gly
HSQGTFTSDYSKYLDXRRAXDFVXWLMXX

SEQ ID NO: 21 - protein, 29 aa, Artificial Sequence
  Synthetic Glucagon Analogue
  MISC_FEATURE: c-term amidation
  MOD_RES (2)..(2): D-Ser, Ala, Gly, N-methyl Ser or aminoisobutyric acid
HXQGTFTSDYSKYLDERRAQDFVQWLMNT

SEQ ID NO: 22 - protein, 29 aa, Artificial Sequence
  Synthetic Glucagon Analogue
  MISC_FEATURE: c-term amidation
  MOD_RES (2)..(2): aminoisobutyric acid
HXQGTFTSDYSKYLDERRAQDFVQWLMNT

SEQ ID NO: 23 - protein, 29 aa, Artificial Sequence
  Synthetic Glucagon Analogue
  MISC_FEATURE: c-term amidation
  MOD_RES (17)..(17): Cys-PEG
  MOD_RES (27)..(27): Met, Leu or Nle
HSQGTFTSDYSKYLDECRAQDFVQWLXNT

SEQ ID NO: 24 - protein, 29 aa, Artificial Sequence
  Synthetic Glucagon Analogue
  MISC_FEATURE: c-term amidation
  MOD_RES (21)..(21): Cys-PEG
  MOD_RES (27)..(27): Met, Leu or Nle
HSQGTFTSDYSKYLDERRAQCFVQWLXNT

SEQ ID NO: 25 - protein, 29 aa, Artificial Sequence
  Synthetic Glucagon Analogue
  MISC_FEATURE: c-term amidation
  MOD_RES (24)..(24): Cys-PEG
  MOD_RES (27)..(27): Met, Leu or Nle
HSQGTFTSDYSKYLDERRAQDFVCWLXNT

SEQ ID NO: 26 - protein, 10 aa, Artificial Sequence
  Synthetic peptide fragment representing the carboxy terminal 10 amino acids Exendin-4
GPSSGAPPPS

SEQ ID NO: 27 - protein, 8 aa, Artificial Sequence
  Synthetic peptide fragment representing the carboxy terminal 8 amino acids of oxyntomodulin
KRNRNNIA

SEQ ID NO: 28 - protein, 4 aa, Artificial Sequence
  Synthetic peptide
KRNR

SEQ ID NO: 29 - protein, 10 aa, Artificial Sequence
  Synthetic peptide fragment representing the carboxy terminal 10 amino acids of Exendin-4
  MISC_FEATURE: c-term amidation
GPSSGAPPPS

SEQ ID NO: 30 - protein, 39 aa, Artificial Sequence
  Synthetic Glucagon Analogue
  MOD_RES (27)..(27): Met, Leu or Nle
HSQGTFTSDYSKYLDERRAQDFVQWLXNTGPSSGAPPPS

SEQ ID NO: 31 - protein, 37 aa, Artificial Sequence
  Synthetic Glucagon Analogue
  MOD_RES (27)..(27): Met, Leu or Nle
HSQGTFTSDYSKYLDERRAQDFVQWLXNTKRNRNNIA

SEQ ID NO: 32 - protein, 33 aa, Artificial Sequence
  Synthetic Glucagon Analogue
  MOD_RES (27)..(27): Met, Leu or Nle
HSQGTFTSDYSKYLDERRAQDFVQWLXNTKRNR

SEQ ID NO: 33 - protein, 29 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or an acidic amino acid
  MOD_RES (29)..(29): Thr, Gly or an acidic amino acid
HSQGTFTSDYSKYLXXRRAXDFVXWLMXX

SEQ ID NO: 34 - protein, 29 aa, Artificial Sequence
  Synthetic Glucagon Analogue
  MOD_RES (15)..(15): Asp, Glu, cysteic acid, homoglutamic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Asp or Lys
  MOD_RES (29)..(29): Thr or Gly
HSQGTFTSDYSKYLXXRRAXDFVXWLMXX

SEQ ID NO: 35 - protein, 29 aa, Artificial Sequence
  Synthetic Glucagon Analogue
HSQGTFTSDYSKYLDSCRAQDFVQWLMNT

SEQ ID NO: 36 - protein, 39 aa, Artificial Sequence
  Synthetic Glucagon Analogue
HSQGTFTSDYSKYLDSRRAQDFVQWLMNTGPSSGAPPPS

SEQ ID NO: 37 - protein, 29 aa, Artificial Sequence
  Synthetic Glucagon Analogue
  MOD_RES (24)..(24): 2-butyrolactone bound through thiol group of Cys
HSQGTFTSDYSKYLDSRRAQDFVCWLMNT

SEQ ID NO: 38 - protein, 29 aa, Artificial Sequence
  Synthetic Glucagon Analogue
  MOD_RES (24)..(24): carboxymethyl group bound through thiol group of Cys
HSQGTFTSDYSKYLDSRRAQDFVCWLMNT

SEQ ID NO: 39 - protein, 39 aa, Artificial Sequence
  Synthetic Glucagon Analogue
HSQGTFTSDYSRYLDSRRAQDFVQWLMNTGPSSGAPPPS

SEQ ID NO: 40 - protein, 29 aa, Artificial Sequence
  Synthetic Glucagon Analogue
  MISC_FEATURE: c-term amidation
  MOD_RES (15)..(15): Glu or Asp
  MOD_RES (28)..(28): Glu or Asp
HSQGTFTSDYSKYLXERRAQDFVQWLMXT

SEQ ID NO: 41 - protein, 29 aa, Artificial Sequence
  Synthetic Glucagon Analogue
  MISC_FEATURE: c-term amidation; lactam ring between side chains at positions 12 and 16
  MOD_RES (15)..(15): Glu or Asp
  MOD_RES (28)..(28): Glu or Asp
HSQGTFTSDYSKYLXERRAQDFVQWLMXT

SEQ ID NO: 42 - protein, 29 aa, Artificial Sequence
  Synthetic Glucagon Analogue
  MISC_FEATURE: c-term amidation; lactam ring between side chains at positions 16 and 20
  MOD_RES (15)..(15): Glu or Asp
  MOD_RES (28)..(28): Glu or Asp
HSQGTFTSDYSKYLXERRAKDFVQWLMXT

SEQ ID NO: 43 - protein, 29 aa, Artificial Sequence
  Synthetic Glucagon Analogue
  MISC_FEATURE: c-term amidation; lactam ring between side chains at positions 20 and 24
  MOD_RES (15)..(15): Glu or Asp
  MOD_RES (28)..(28): Glu or Asp
HSQGTFTSDYSKYLXSRRAKDFVEWLMXT

SEQ ID NO: 44 - protein, 29 aa, Artificial Sequence
  Synthetic Glucagon Analogue
  MISC_FEATURE: c-term amidation; lactam ring between side chains at positions 24 and 28
  MOD_RES (15)..(15): Glu or Asp
  MOD_RES (29)..(29): Glu or Thr
HSQGTFTSDYSKYLXSRRAQDFVEWLMKX

SEQ ID NO: 45 - protein, 29 aa, Artificial Sequence
  Synthetic Glucagon Analogue
  MOD_RES (12)..(12): Lys or Glu
  MOD_RES (15)..(15): Asp, Glu, homoglutamic acid, cysteic acid or homocysteic acid
  MOD_RES (16)..(16): Ser, Gln, Glu, Lys, homoglutamic acid, cysteic acid or homocysteic acid
  MOD_RES (20)..(20): Gln, Glu or Lys
  MOD_RES (24)..(24): Gln, Lys or Glu
  MOD_RES (28)..(28): Asn, Lys or an acidic amino acid
  MOD_RES (29)..(29): Thr, Gly or an acidic amino acid
HSQGTFTSDYSXYLXXRRAXDFVXWLMXX

SEQ ID NO: 46 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln or Lys
  MOD_RES (24)..(24): Gln or Glu
HSQGTFTSDYSKYLDXRRAXDFVXWLMNT

SEQ ID NO: 47 - protein, 29 aa, Artificial Sequence
  Synthetic Glucagon Analogue
HSQGTFTSDYSKYLDERRAKDFVQWLMNT

SEQ ID NO: 48 - protein, 29 aa, Artificial Sequence
  Synthetic Glucagon Analogue
HSQGTFTSDYSKYLDSRRAKDFVEWLMNT

SEQ ID NO: 49 - protein, 29 aa, Artificial Sequence
  Synthetic Glucagon Analogue
HSQGTFTSDYSKYLDSRRAQDFVEWLMKT

SEQ ID NO: 50 - protein, 31 aa, Homo sapiens
HAEGTFTSDVSSYLEGQAAKEFIAWLVKGRG

SEQ ID NO: 51 - protein, 29 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln, Lys, Arg, Orn, or Citrulline
  MOD_RES (21)..(21): Asp, Glu, homoglutamic acid, or homocysteic acid
  MOD_RES (24)..(24): Gln or Glu
  MOD_RES (28)..(28): Asn, Lys or an acidic amino acid
  MOD_RES (29)..(29): Thr, Gly or an acidic amino acid
HSQGTFTSDYSKYLXXRRAXXFVXWLMXX

SEQ ID NO: 52 - protein, 30 aa, Artificial Sequence
  Synthetic peptide
  MISC_FEATURE: c-term amidation
HAEGTFTSDVSSYLEGQAAKEFIAWLVKGR

SEQ ID NO: 53 - protein, 29 aa, Artificial Sequence
  Synthetic Glucagon Analogue
  MOD_RES (3)..(3): Glu, Orn or Nle
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or an acidic amino acid
  MOD_RES (29)..(29): Thr or an acidic amino acid
HSXGTFTSDYSKYLXXRRAXDFVXWLMXX

SEQ ID NO: 54 - protein, 29 aa, Artificial Sequence
  Synthetic Glucagon Analogue
  MOD_RES (17)..(17): Arg or Gln
  MOD_RES (18)..(18): Arg or Ala
  MOD_RES (21)..(21): Asp or Glu
  MOD_RES (23)..(23): Val or Ile
  MOD_RES (24)..(24): Gln or Ala
HSQGTFTSDYSKYLDEXXAKXFXXWLMNT

SEQ ID NO: 55 - protein, 29 aa, Artificial Sequence
  Synthetic Glucagon Analogue
  MOD_RES (1)..(1): His, D-His, (Des-amino)His, hydroxyl-His, acetyl-His, homo-His or alpha, alpha-dimethyl imidiazole acetic acid (DMIA), N-methyl His, alpha-methyl His, or imidazole acetic acid
  MOD_RES (2)..(2): Ser, D-Ser, Ala, D-Ala, Val, Gly, N-methyl Ser, aminoisobutyric acid (AIB) or N-methyl Ala
  MOD_RES (3)..(3): Gln, Glu, Orn or  Nle
  MOD_RES (10)..(10): Tyr or Trp
  MOD_RES (12)..(12): Lys, Citrulline, Orn or Arg
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (17)..(17): Arg, Gln, Lys, Cys, Orn, homocysteine or acetyl phenylalanine
  MOD_RES (18)..(18): Arg, Ala, Lys, Cys, Orn, homocysteine or acetyl phenyalanine
  MOD_RES (20)..(20): Gln, Lys, Arg, Orn or Citrulline
  MOD_RES (21)..(21): Gln, Glu, Asp, Lys, Cys, Orn, homocystein or acetyl phenyalanine
  MOD_RES (23)..(23): Val or Ile
  MOD_RES (24)..(24): Ala, Gln, Glu, Lys, Cys, Orn, homocysteine or acetyl phenyalanine
  MOD_RES (27)..(27): Met, Leu or Nle
  MOD_RES (28)..(28): Asn, Arg, Citrulline, Orn, Lys or Asp
  MOD_RES (29)..(29): Thr, Gly, Lys, Cys, Orn, homocycsteine or acetyl phenyalanine
XXXGTFTSDXSXYLXXXXAXXFXXWLXXX

SEQ ID NO: 56 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (20)..(20): Gln, Lys, Arg, Orn or Citrulline
  MOD_RES (21)..(21): Gln, Glu, Asp, Cys, Orn, homocycstein or acetyl phenyalanine
  MOD_RES (23)..(23): Val or Ile
  MOD_RES (24)..(24): Ala, Gln, Glu, Cys, Orn, homocycsteine or acetyl phenyalanine
  MOD_RES (27)..(27): Met, Leu or Nle
  MOD_RES (28)..(28): Asn, Lys or Asp
  MOD_RES (29)..(29): Thr, Gly, Lys, Cys, Orn, homocycsteine or acetyl phenyalanine
XXXGTFTSDYSKYLXXRRAXXFXXWLXXX

SEQ ID NO: 57 - protein, 29 aa, Artificial Sequence
  Synthetic Glucagon Analogue
  MISC_FEATURE: lactam ring between side changes at position 12 and 16
  MOD_RES (1)..(1): His, D-His, (Des-amino)His, hydroxyl-His, acetyl- His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (20)..(20): Gln, Lys, Arg, Orn or Citrulline
  MOD_RES (21)..(21): Gln, Glu, Asp, Cys, Orn, homocycsteine or acetyl phenyalanine
  MOD_RES (23)..(23): Val or Ile
  MOD_RES (24)..(24): Ala, Gln, Glu, Lys, Cys, Orn, homocysteine or acetyl Phe
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl phenyalanine
XXXGTFTSDYSKYLXERRAXXFXXWLXXX

SEQ ID NO: 58 - protein, 29 aa, Artificial Sequence
  Synthetic Glucagon Analogue
  MISC_FEATURE: lactam ring between side chains at positions 16 and 20
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or Nle
  MOD_RES (15)..(15): Asp, Glu, cysteic acid, homoglutamic acid or homocysteic acid
  MOD_RES (21)..(21): Gln, Glu, Asp, Lys, Cys, Orn, homocysteine or acetyl phenyalanine
  MOD_RES (23)..(23): Val or Ile
  MOD_RES (24)..(24): Ala, Gln, Glu, Lys, Cys, Orn, homocysteine or acetyl phenyalanine
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl phenyalanine
XXXGTFTSDYSKYLXERRAKXFXXWLXXX

SEQ ID NO: 59 - protein, 29 aa, Artificial Sequence
  Synthetic Glucagon Analogue
  MISC_FEATURE: lactam ring between side chains at position 20 and 24
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB, or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (21)..(21): Gln, Glu, Asp, Lys, Cys, Orn, homocysteine or acetyl phenyalanine
  MOD_RES (23)..(23): Val or Ile
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl pheylalanine
XXXGTFTSDYSKYLXXRRAKXFXEWLXXX

SEQ ID NO: 60 - protein, 29 aa, Artificial Sequence
  Synthetic Glucagon Analogue
  MISC_FEATURE: lactam ring between side chains at position 24 and 28
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (20)..(20): Gln, Lys, Arg, Orn, or Citrulline
  MOD_RES (21)..(21): Gln, Glu, Asp, Lys, Cys, Orn, homocysteine or acetyl phenyalanine
  MOD_RES (23)..(23): Val or Ile
  MOD_RES (27)..(27): Met, Leu or Nle
  MOD_RES (29)..(29): Thr, Gly, Lys, Cys, Orn, homocysteine or acetyl phenyalanine
XXXGTFTSDYSKYLXXRRAXXFXEWLXKX

SEQ ID NO: 61 - protein, 40 aa, Artificial Sequence
  Synthetic Glucagon Analogue
  MISC_FEATURE: positions 30 to 40 are present only if position 29 is Gly; see specification as filed for detailed description of substitutions and preferred embodiments
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, Val, Gly, N-methyl Ser, Aib, N-methyl, Ala or D-Ala
  MOD_RES (18)..(18): Ala or Arg
  MOD_RES (24)..(24): Ala, Gln or Cys-PEG
  MOD_RES (29)..(29): Thr-CONH2, Cys-PEG, or Gly
  MOD_RES (40)..(40): Cys-PEG or not present
XXQGTFTSDYSKYLDERXAKDFVXWLMNXGPSSGAPPPSC

SEQ ID NO: 62 - protein, 40 aa, Artificial Sequence
  Synthetic Glucagon Analogue
  MISC_FEATURE: positions 30 to 40 are present only if position 29 is Gly; see specification as filed for detailed description of substitutions and preferred embodiments
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, Val, Gly, N-methyl Ser, AIB0, N-methyl Ala, or D-Ala
  MOD_RES (18)..(18): Ala or Arg
  MOD_RES (24)..(24): Ala, Gln or Cys-PEG
  MOD_RES (29)..(29): Thr-CONH2, Cys-PEG, or Gly
  MOD_RES (40)..(40): Cys-PEG or not present
XXQGTFTSDYSKYLDEQXAKEFIXWLMNXGPSSGAPPPSC

SEQ ID NO: 63 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln or Lys
  MOD_RES (21)..(21): Asp, Lys, Cys, Orn, homocysteine or acetyl phealanine
  MOD_RES (24)..(24): Gln, Lys, Cys, Orn, homocysteine or acetyl phealanine
  MOD_RES (27)..(27): Met, Leu or Nle
HSQGTFTSDYSKYLDXRRAXXFVXWLXNT

SEQ ID NO: 64 - protein, 38 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or Asp
HSQGTFTSDYSKYLXXRRAXDFVXWLMXGGPSSGPPPS

SEQ ID NO: 65 - protein, 11 aa, Artificial Sequence
  Synthetic peptide fragment representing the carboxy terminal 10 amino acids of Exdendin-4
  MOD_RES (11)..(11): Cys-PEG
GPSSGAPPPSC

SEQ ID NO: 66 - protein, 29 aa, Artificial Sequence
  Synthetic Glucagon Analogue
  MISC_FEATURE: lactam ring between side chains at positions 12 and 16
  MOD_RES (28)..(28): Asp or Asn
  MOD_RES (29)..(29): Thr or Gly
HSQGTFTSDYSKYLDERRAQDFVQWLMXX

SEQ ID NO: 67 - protein, 29 aa, Artificial Sequence
  Synthetic Glucagon Analogue
  MISC_FEATURE: lactam ring between side chains at positions 16 and 20
  MOD_RES (28)..(28): Asp or Asn
  MOD_RES (29)..(29): Thr or Gly
HSQGTFTSDYSKYLDERRAKDFVQWLMXX

SEQ ID NO: 68 - protein, 29 aa, Artificial Sequence
  Synthetic Glucagon Analogue
  MISC_FEATURE: lactam ring between side chains at positions 20 and 24
  MOD_RES (28)..(28): Asp or Asn
  MOD_RES (29)..(29): Thr or Gly
HSQGTFTSDYSKYLDSRRAKDFVEWLMXX

SEQ ID NO: 69 - protein, 29 aa, Artificial Sequence
  glucagon analogue
  MISC_FEATURE: lactam ring between side chains at positions24 and 28
  MOD_RES (29)..(29): Thr or Gly
HSQGTFTSDYSKYLDSRRAQDFVEWLMKX

SEQ ID NO: 70 - protein, 29 aa, Artificial Sequence
  Synthetic peptide
  MISC_FEATURE: c-term amidation
HSQGTFTSDYSKYLDERRAQDFVQWLMNT

SEQ ID NO: 71 - protein, 29 aa, Artificial Sequence
  Synthetic peptide
  MISC_FEATURE: c-term amidation
HSQGTFTSDYSKYLDERRAKDFVQWLMNT

SEQ ID NO: 72 - protein, 29 aa, Artificial Sequence
  Synthetic peptide
  MISC_FEATURE: c-term amidation; lactam ring between side chains at positions 16 and 20
HSQGTFTSDYSKYLDERRAKDFVQWLMNT

SEQ ID NO: 73 - protein, 29 aa, Artificial Sequence
  Synthetic peptide
  MISC_FEATURE: c-term amidation; lactam ring between side chains at positions 12 and 16
HSQGTFTSDYSKYLDERRAQDFVQWLMNT

SEQ ID NO: 74 - protein, 29 aa, Artificial Sequence
  Synthetic peptide
  MISC_FEATURE: c-term amidation; lactam ring between side chains at positions 12 and 16
HSQGTFTSDYSKYLDERRAKDFVQWLMNT

SEQ ID NO: 75 - protein, 29 aa, Artificial Sequence
  Synthetic peptide
  MISC_FEATURE: c-term amidation; lactam ring between side chains at positions 16 and 20
HSQGTFTSDYSKYLDKRRAEDFVQWLMNT

SEQ ID NO: 76 - protein, 29 aa, Artificial Sequence
  Synthetic peptide
  MISC_FEATURE: c-term amidation
HSQGTFTSDYSKYLDERAAKDFVQWLMNT

SEQ ID NO: 77 - protein, 29 aa, Artificial Sequence
  Synthetic Polypeptide
  MISC_FEATURE: c-term amidation; lactam ring between side chains at positions 16 and 20
HSQGTFTSDYSKYLDERAAKDFVQWLMNT

SEQ ID NO: 78 - protein, 29 aa, Artificial Sequence
  Synthetic Polypeptide
  MISC_FEATURE: c-term amidation; lactam ring between side chains at positions 12 and 16
HSQGTFTSDYSKYLDERAAQDFVQWLMNT

SEQ ID NO: 79 - protein, 29 aa, Artificial Sequence
  Synthetic Polypeptide
  MISC_FEATURE: c-term amidation; lactam ring between side chains at positions 12 and 16
HSQGTFTSDYSKYLDERAAKDFVQWLMNT

SEQ ID NO: 80 - protein, 29 aa, Artificial Sequence
  Synthetic Polypeptide
  MISC_FEATURE: c-term amidation; lactam ring between side chains at positions 16 and 20
HSQGTFTSDYSKYLDKRAAEDFVQWLMNT

SEQ ID NO: 81 - protein, 29 aa, Artificial Sequence
  Synthetic Polypeptide
  MISC_FEATURE: c-term amidation
HSQGTFTSDYSKYLDEQAAKEFIAWLMNT

SEQ ID NO: 82 - protein, 29 aa, Artificial Sequence
  Synthetic Polypeptide
  MISC_FEATURE: c-term amidation; lactam ring between side chains at positions 12 and 16
HSQGTFTSDYSKYLDEQAAKEFIAWLMNT

SEQ ID NO: 83 - protein, 29 aa, Artificial Sequence
  Synthetic Polypeptide
  MISC_FEATURE: c-term amidation; lactam ring between side chains at positions 16 and 20
HSQGTFTSDYSKYLDEQAAKEFIAWLMNT

SEQ ID NO: 84 - protein, 29 aa, Artificial Sequence
  Synthetic Polypeptide
  MISC_FEATURE: c-term amidation
HSQGTFTSDYSKYLDEQAAKEFIAWLVKG

SEQ ID NO: 85 - protein, 29 aa, Artificial Sequence
  Synthetic Polypeptide
  MISC_FEATURE: c-term amidation; lactam ring between side chains at positions 12 and 16
HSQGTFTSDYSKYLDEQAAKEFIAWLVKG

SEQ ID NO: 86 - protein, 29 aa, Artificial Sequence
  Synthetic Polypeptide
  MISC_FEATURE: c-term amidation; lactam ring between side chains at positions 16 and 20
HSQGTFTSDYSKYLDEQAAKEFIAWLVKG

SEQ ID NO: 87 - protein, 29 aa, Artificial Sequence
  Synthetic Polypeptide
  MISC_FEATURE: c-term amidation
  MOD_RES (1)..(1): (Des-amino)His
XSQGTFTSDYSKYLDERRAQDFVQWLMNT

SEQ ID NO: 88 - protein, 29 aa, Artificial Sequence
  Synthetic Polypeptide
  MISC_FEATURE: c-term amidation
  MOD_RES (1)..(1): (Des-amino)His
XSQGTFTSDYSKYLDERRAKDFVQWLMNT

SEQ ID NO: 89 - protein, 29 aa, Artificial Sequence
  Synthetic Polypeptide
  MISC_FEATURE: c-term amidation; lactam ring between side chains at positions 16 and 20
  MOD_RES (1)..(1): (Des-amino)His
XSQGTFTSDYSKYLDERRAKDFVQWLMNT

SEQ ID NO: 90 - protein, 29 aa, Artificial Sequence
  Synthetic Polypeptide
  MOD_RES (1)..(1): (Des-amino)His
  MISC_FEATURE (12)..(16): c-term amidation; lactam ring between side chains at positions 12 and 16
XSQGTFTSDYSKYLDERRAQDFVQWLMNT

SEQ ID NO: 91 - protein, 29 aa, Artificial Sequence
  Synthetic Polypeptide
  MISC_FEATURE: c-term amidation; lactam ring between side chains at positions 12 and 16
  MOD_RES (1)..(1): (Des-amino)His
XSQGTFTSDYSKYLDERRAKDFVQWLMNT

SEQ ID NO: 92 - protein, 29 aa, Artificial Sequence
  Synthetic Polypeptide
  MISC_FEATURE: c-term amidation; lactam ring between side chains at positions 16 and 20
  MOD_RES (1)..(1): (Des-amino)His
XSQGTFTSDYSKYLDKRRAEDFVQWLMNT

SEQ ID NO: 93 - protein, 29 aa, Artificial Sequence
  Synthetic Polypeptide
  MOD_RES (1)..(1): (Des-amino)His
  MISC_FEATURE (29)..(29): c-term amidation
XSQGTFTSDYSKYLDERAAKDFVQWLMNT

SEQ ID NO: 94 - protein, 29 aa, Artificial Sequence
  Synthetic Polypeptide
  MISC_FEATURE: c-term amidation; lactam ring between side chains at positions 16 and 20
  MOD_RES (1)..(1): (Des-amino)His
XSQGTFTSDYSKYLDERAAKDFVQWLMNT

SEQ ID NO: 95 - protein, 29 aa, Artificial Sequence
  Synthetic Polypeptide
  MISC_FEATURE: c-term amidation; lactam ring between side chains at positions 12 and 16
  MOD_RES (1)..(1): (Des-amino)His
XSQGTFTSDYSKYLDERAAQDFVQWLMNT

SEQ ID NO: 96 - protein, 29 aa, Artificial Sequence
  Synthetic Polypeptide
  MISC_FEATURE: c-term amidation; lactam ring between side chains at positions 12 and 16
  MOD_RES (1)..(1): (Des-amino)His
XSQGTFTSDYSKYLDERAAKDFVQWLMNT

SEQ ID NO: 97 - protein, 29 aa, Artificial Sequence
  Synthetic Polypeptide
  MISC_FEATURE: c-term amidation; lactam ring between side chains at positions 16 and 20
  MOD_RES (1)..(1): (Des-amino)His
XSQGTFTSDYSKYLDKRAAEDFVQWLMNT

SEQ ID NO: 98 - protein, 29 aa, Artificial Sequence
  Synthetic Polypeptide
  MOD_RES (1)..(1): (Des-amino)His
  MISC_FEATURE (12)..(16): c-term amidation; lactam ring between side chains at positions 12 and 16
XSQGTFTSDYSKYLDEQAAKEFIAWLMNT

SEQ ID NO: 99 - protein, 29 aa, Artificial Sequence
  Synthetic Polypeptide
  MISC_FEATURE: c-term amidation; lactam ring between side chains at positions 12 and 16
  MOD_RES (1)..(1): (Des-amino)His
XSQGTFTSDYSKYLDEQAAKEFIAWLMNT

SEQ ID NO: 100 - protein, 29 aa, Artificial Sequence
  Synthetic Polypeptide
  MISC_FEATURE: c-term amidation; lactam ring between side chains at positions 16 and 20
  MOD_RES (1)..(1): (Des-amino)His
XSQGTFTSDYSKYLDEQAAKEFIAWLMNT

SEQ ID NO: 101 - protein, 29 aa, Artificial Sequence
  Synthetic Polypeptide
  MISC_FEATURE: c-term amidation
  MOD_RES (1)..(1): (Des-amino)His
XSQGTFTSDYSKYLDEQAAKEFIAWLVKG

SEQ ID NO: 102 - protein, 29 aa, Artificial Sequence
  Synthetic Polypeptide
  MOD_RES (1)..(1): (Des-amino)His
  MISC_FEATURE (12)..(16): c-term amidation; lactam ring between side chains at positions 12 and 16
XSQGTFTSDYSKYLDEQAAKEFIAWLVKG

SEQ ID NO: 103 - protein, 29 aa, Artificial Sequence
  Synthetic Polypeptide
  MOD_RES (1)..(1): (Des-amino)His
  MISC_FEATURE (16)..(20): c-term amidation; lactam ring between side chains at positions 16 and 20
XSQGTFTSDYSKYLDEQAAKEFIAWLVKG

SEQ ID NO: 104 - protein, 29 aa, Artificial Sequence
  Synthetic Polypeptide
  MOD_RES (2)..(2): Aminoisobutyric acid
  MISC_FEATURE (29)..(29): c-term amidation
HXQGTFTSDYSKYLDERRAQDFVQWLMNT

SEQ ID NO: 105 - protein, 29 aa, Artificial Sequence
  Synthetic Polypeptide
  MISC_FEATURE: c-term amidation; lactam ring between side chains at positions 16 and 20
  MOD_RES (2)..(2): Aminoisobutyric acid
HXQGTFTSDYSKYLDERRAKDFVQWLMNT

SEQ ID NO: 106 - protein, 29 aa, Artificial Sequence
  Synthetic Polypeptide
  MISC_FEATURE: c-term amidation; lactam ring between side chains at positions 16 and 20
  MOD_RES (2)..(2): Aminoisobutyric acid
HXQGTFTSDYSKYLDERRAKDFVQWLMNT

SEQ ID NO: 107 - protein, 29 aa, Artificial Sequence
  Synthetic Polypeptide
  MISC_FEATURE: c-term amidation; lactam ring between side chains at positions 12 and 16
  MOD_RES (2)..(2): Aminoisobutyric acid
HXQGTFTSDYSKYLDERRAQDFVQWLMNT

SEQ ID NO: 108 - protein, 29 aa, Artificial Sequence
  Synthetic Polypeptide
  MISC_FEATURE: c-term amidation; lactam ring between side chains at positions 12 and 16
  MOD_RES (2)..(2): Aminoisebutyric acid
HXQGTFTSDYSKYLDERRAKDFVQWLMNT

SEQ ID NO: 109 - protein, 29 aa, Artificial Sequence
  Synthetic Polypeptide
  MISC_FEATURE: c-term amidation; lactam ring between side chains at positions 16 and 20
  MOD_RES (2)..(2): Aminoisobutyric acid
HXQGTFTSDYSKYLDKRRAEDFVQWLMNT

SEQ ID NO: 110 - protein, 29 aa, Artificial Sequence
  Synthetic Polypeptide
  MISC_FEATURE: c-term amidation
  MOD_RES (2)..(2): Aminoisobutyric acid
HXQGTFTSDYSKYLDERAAKDFVQWLMNT

SEQ ID NO: 111 - protein, 29 aa, Artificial Sequence
  Synthetic Polypeptide
  MOD_RES (2)..(2): Aminoisobutyric acid
  MISC_FEATURE (16)..(20): c-term amidation; lactam ring between side chains at positions 16 and 20
HXQGTFTSDYSKYLDERAAKDFVQWLMNT

SEQ ID NO: 112 - protein, 29 aa, Artificial Sequence
  Synthetic Polypeptide
  MISC_FEATURE: c-term amidation; lactam ring between side chains at positions 12 and 16
  MOD_RES (2)..(2): Aminoisobutryic acid
HXQGTFTSDYSKYLDERAAQDFVQWLMNT

SEQ ID NO: 113 - protein, 29 aa, Artificial Sequence
  glucagon analog
  MISC_FEATURE: c-term amidation; lactam ring between side chains at positions 12 and 16
  MOD_RES (2)..(2): Aminoisobutryic acid
HXQGTFTSDYSKYLDERAAKDFVQWLMNT

SEQ ID NO: 114 - protein, 29 aa, Artificial Sequence
  glucagon analog
  MISC_FEATURE: c-term amidation; lactam ring between side chains at positions 16 and 20
  MOD_RES (2)..(2): Aminoisobutryic acid
HXQGTFTSDYSKYLDKRAAEDFVQWLMNT

SEQ ID NO: 115 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLMNT

SEQ ID NO: 116 - protein, 29 aa, Artificial Sequence
  glucagon analog
  MISC_FEATURE: c-term amidation; lactam ring between side chains at positions 12 and 16
  MOD_RES (2)..(2): Aminoisobutryic acid
HXQGTFTSDYSKYLDEQAAKEFIAWLMNT

SEQ ID NO: 117 - protein, 29 aa, Artificial Sequence
  glucagon analog
  MISC_FEATURE: c-term amidation; lactam ring between side chains at positions 16 and 20
  MOD_RES (2)..(2): Aminoisobutryic acid
HXQGTFTSDYSKYLDEQAAKEFIAWLMNT

SEQ ID NO: 118 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLVKG

SEQ ID NO: 119 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXQGTFTSDYSKYLDEQAAKEFIAWLVKG

SEQ ID NO: 120 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXQGTFTSDYSKYLDEQAAKEFIAWLVKG

SEQ ID NO: 121 - protein, 29 aa, Artificial Sequence
  glucagon analog
  MISC_FEATURE: c-term amidation
  MOD_RES (2)..(2): D-Ala
HXQGTFTSDYSKYLDERRAQDFVQWLMNT

SEQ ID NO: 122 - protein, 29 aa, Artificial Sequence
  glucagon analog
  MISC_FEATURE: c-term amidation
  MOD_RES (2)..(2): D-Ala
HXQGTFTSDYSKYLDERRAKDFVQWLMNT

SEQ ID NO: 123 - protein, 29 aa, Artificial Sequence
  glucagon analog
  MISC_FEATURE: c-term amidation; lactam ring between side chains at positions 16 and 20
  MOD_RES (2)..(2): D-Ala
HXQGTFTSDYSKYLDERRAKDFVQWLMNT

SEQ ID NO: 124 - protein, 29 aa, Artificial Sequence
  glucagon analog
  MISC_FEATURE: c-term amidation; lactam ring between side chains at positions 12 and 16
  MOD_RES (2)..(2): D-Ala
HXQGTFTSDYSKYLDERRAQDFVQWLMNT

SEQ ID NO: 125 - protein, 29 aa, Artificial Sequence
  glucagon analog
  MISC_FEATURE: c-term amidation; lactam ring between side chains at positions 12 and 16
  MOD_RES (2)..(2): D-Ala
HXQGTFTSDYSKYLDERRAKDFVQWLMNT

SEQ ID NO: 126 - protein, 29 aa, Artificial Sequence
  glucagon analog
  MISC_FEATURE: c-term amidation; lactam ring between side chains at positions 16 and 20
  MOD_RES (2)..(2): D-Ala
HXQGTFTSDYSKYLDKRRAEDFVQWLMNT

SEQ ID NO: 127 - protein, 29 aa, Artificial Sequence
  glucagon analog
  MISC_FEATURE: c-term amidation
  MOD_RES (2)..(2): D-Ala
HXQGTFTSDYSKYLDERAAKDFVQWLMNT

SEQ ID NO: 128 - protein, 29 aa, Artificial Sequence
  glucagon analog
  MISC_FEATURE: c-term amidation; lactam ring between side chains at positions 16 and 20
  MOD_RES (2)..(2): D-Ala
HXQGTFTSDYSKYLDERAAKDFVQWLMNT

SEQ ID NO: 129 - protein, 29 aa, Artificial Sequence
  glucagon analog
  MISC_FEATURE: c-term amidation; lactam ring between side chains at positions 12 and 16
  MOD_RES (2)..(2): D-Ala
HXQGTFTSDYSKYLDERAAQDFVQWLMNT

SEQ ID NO: 130 - protein, 29 aa, Artificial Sequence
  glucagon analog
  MISC_FEATURE: c-term amidation; lactam ring between side chains at positions 12 and 16
  MOD_RES (2)..(2): D-Ala
HXQGTFTSDYSKYLDERAAKDFVQWLMNT

SEQ ID NO: 131 - protein, 29 aa, Artificial Sequence
  glucagon analog
  MISC_FEATURE: c-term amidation; lactam ring between side chains at positions 16 and 20
  MOD_RES (2)..(2): D-Ala
HXQGTFTSDYSKYLDKRAAEDFVQWLMNT

SEQ ID NO: 132 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLMNT

SEQ ID NO: 133 - protein, 29 aa, Artificial Sequence
  glucagon analog
  MISC_FEATURE: c-term amidation; lactam ring between side chains at positions 12 and 16
  MOD_RES (2)..(2): D-Ala
HXQGTFTSDYSKYLDEQAAKEFIAWLMNT

SEQ ID NO: 134 - protein, 29 aa, Artificial Sequence
  glucagon analog
  MISC_FEATURE: c-term amidation; lactam ring between side chains at positions 16 and 20
  MOD_RES (2)..(2): D-Ala
HXQGTFTSDYSKYLDEQAAKEFIAWLMNT

SEQ ID NO: 135 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLVKG

SEQ ID NO: 136 - protein, 29 aa, Artificial Sequence
  glucagon analog
  MISC_FEATURE: c-term amidation; lactam ring between side chains at positions 12 and 16
  MOD_RES (2)..(2): D-Ala
HXQGTFTSDYSKYLDEQAAKEFIAWLVKG

SEQ ID NO: 137 - protein, 29 aa, Artificial Sequence
  glucagon analog
  MISC_FEATURE: c-term amidation; lactam ring between side chains at positions 16 and 20
  MOD_RES (2)..(2): D-Ala
HXQGTFTSDYSKYLDEQAAKEFIAWLVKG

SEQ ID NO: 138 - protein, 29 aa, Artificial Sequence
  glucagon analog
  MISC_FEATURE: c-term amidation
HSEGTFTSDYSKYLDERRAQDFVQWLMNT

SEQ ID NO: 139 - protein, 29 aa, Artificial Sequence
  glucagon analog
  MISC_FEATURE: c-term amidation
HSEGTFTSDYSKYLDERRAKDFVQWLMNT

SEQ ID NO: 140 - protein, 29 aa, Artificial Sequence
  glucagon analog
  MISC_FEATURE: c-term amidation; lactam ring between side chains at positions 16 and 20
HSEGTFTSDYSKYLDERRAKDFVQWLMNT

SEQ ID NO: 141 - protein, 29 aa, Artificial Sequence
  glucagon analog
  MISC_FEATURE: c-term amidation; lactam ring between side chains at positions 12 and 16
HSEGTFTSDYSKYLDERRAQDFVQWLMNT

SEQ ID NO: 142 - protein, 29 aa, Artificial Sequence
  glucagon analog
  MISC_FEATURE: c-term amidation; lactam ring between side chains at positions 12 and 16
HSEGTFTSDYSKYLDERRAKDFVQWLMNT

SEQ ID NO: 143 - protein, 29 aa, Artificial Sequence
  glucagon analog
  MISC_FEATURE: c-term amidation; lactam ring between side chains at positions 16 and 20
HSEGTFTSDYSKYLDKRRAEDFVQWLMNT

SEQ ID NO: 144 - protein, 29 aa, Artificial Sequence
  glucagon analog
  MISC_FEATURE: c-term amidation
HSEGTFTSDYSKYLDERAAKDFVQWLMNT

SEQ ID NO: 145 - protein, 29 aa, Artificial Sequence
  glucagon analog
  MISC_FEATURE: c-term amidation; lactam ring between side chains at positions 16 and 20
HSEGTFTSDYSKYLDERAAKDFVQWLMNT

SEQ ID NO: 146 - protein, 29 aa, Artificial Sequence
  glucagon analog
  MISC_FEATURE: c-term amidation; lactam ring between side chains at positions 12 and 16
HSEGTFTSDYSKYLDERAAQDFVQWLMNT

SEQ ID NO: 147 - protein, 29 aa, Artificial Sequence
  glucagon analog
  MISC_FEATURE: c-term amidation; lactam ring between side chains at positions 12 and 16
HSEGTFTSDYSKYLDERAAKDFVQWLMNT

SEQ ID NO: 148 - protein, 29 aa, Artificial Sequence
  glucagon analog
  MISC_FEATURE: c-term amidation; lactam ring between side chains at positions 16 and 20
HSEGTFTSDYSKYLDKRAAEDFVQWLMNT

SEQ ID NO: 149 - protein, 29 aa, Artificial Sequence
  glucagon analog
  MISC_FEATURE: c-term amidation
HSEGTFTSDYSKYLDEQAAKEFIAWLMNT

SEQ ID NO: 150 - protein, 29 aa, Artificial Sequence
  glucagon analog
  MISC_FEATURE: c-term amidation; lactam ring between side chains at positions 12 and 16
HSEGTFTSDYSKYLDEQAAKEFIAWLMNT

SEQ ID NO: 151 - protein, 29 aa, Artificial Sequence
  glucagon analog
  MISC_FEATURE: c-term amidation; lactam ring between side chains at positions 16 and 20
HSEGTFTSDYSKYLDEQAAKEFIAWLMNT

SEQ ID NO: 152 - protein, 29 aa, Artificial Sequence
  glucagon analog
  MISC_FEATURE: c-term amidation
HSEGTFTSDYSKYLDEQAAKEFIAWLVKG

SEQ ID NO: 153 - protein, 29 aa, Artificial Sequence
  glucagon analog
  MISC_FEATURE: c-term amidation; lactam ring between side chains at positions 12 and 16
HSEGTFTSDYSKYLDEQAAKEFIAWLVKG

SEQ ID NO: 154 - protein, 29 aa, Artificial Sequence
  glucagon analog
  MISC_FEATURE: c-term amidation; lactam ring between side chains at positions 16 and 20
HSEGTFTSDYSKYLDEQAAKEFIAWLVKG

SEQ ID NO: 155 - protein, 29 aa, Artificial Sequence
  glucagon analog
  MISC_FEATURE: c-term amidation
  MOD_RES (1)..(1): (Des-amino)His
XSEGTFTSDYSKYLDERRAQDFVQWLMNT

SEQ ID NO: 156 - protein, 29 aa, Artificial Sequence
  glucagon analog
  MISC_FEATURE: c-term amidation
  MOD_RES (1)..(1): (Des-amino)His
XSEGTFTSDYSKYLDERRAKDFVQWLMNT

SEQ ID NO: 157 - protein, 29 aa, Artificial Sequence
  glucagon analog
  MISC_FEATURE: c-term amidation; lactam ring between side chains at positions 16 and 20
  MOD_RES (1)..(1): (Des-amino)His
XSEGTFTSDYSKYLDERRAKDFVQWLMNT

SEQ ID NO: 158 - protein, 29 aa, Artificial Sequence
  glucagon analog
  MISC_FEATURE: c-term amidation; lactam ring between side chains at positions 12 and 16
  MOD_RES (1)..(1): (Des-amino)His
XSEGTFTSDYSKYLDERRAQDFVQWLMNT

SEQ ID NO: 159 - protein, 29 aa, Artificial Sequence
  glucagon analog
  MISC_FEATURE: c-term amidation; lactam ring between side chains at positions 12 and 16
  MOD_RES (1)..(1): (Des-amino)His
XSEGTFTSDYSKYLDERRAKDFVQWLMNT

SEQ ID NO: 160 - protein, 29 aa, Artificial Sequence
  glucagon analog
  MISC_FEATURE: c-term amidation; lactam ring between side chains at positions 16 and 20
  MOD_RES (1)..(1): (Des-amino)His
XSEGTFTSDYSKYLDKRRAEDFVQWLMNT

SEQ ID NO: 161 - protein, 29 aa, Artificial Sequence
  glucagon analog
  MISC_FEATURE: c-term amidation
  MOD_RES (1)..(1): (Des-amino)His
XSEGTFTSDYSKYLDERAAKDFVQWLMNT

SEQ ID NO: 162 - protein, 29 aa, Artificial Sequence
  glucagon analog
  MISC_FEATURE: c-term amidation; lactam ring between side chains at positions 16 and 20
  MOD_RES (1)..(1): (Des-amino)His
XSEGTFTSDYSKYLDERAAKDFVQWLMNT

SEQ ID NO: 163 - protein, 29 aa, Artificial Sequence
  glucagon analog
  MISC_FEATURE: c-term amidation; lactam ring between side chains at positions 12 and 16
  MOD_RES (1)..(1): (Des-amino)His
XSEGTFTSDYSKYLDERAAQDFVQWLMNT

SEQ ID NO: 164 - protein, 29 aa, Artificial Sequence
  glucagon analog
  MISC_FEATURE: c-term amidation; lactam ring between side chains at positions 12 and 16
  MOD_RES (1)..(1): (Des-amino)His
XSEGTFTSDYSKYLDERAAKDFVQWLMNT

SEQ ID NO: 165 - protein, 29 aa, Artificial Sequence
  glucagon analog
  MISC_FEATURE: c-term amidation; lactam ring between side chains at positions 16 and 20
  MOD_RES (1)..(1): (Des-amino)His
XSEGTFTSDYSKYLDKRAAEDFVQWLMNT

SEQ ID NO: 166 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLMNT

SEQ ID NO: 167 - protein, 29 aa, Artificial Sequence
  glucagon analog
  MISC_FEATURE: c-term amidation; lactam ring between side chains at positions 12 and 16
  MOD_RES (1)..(1): (Des-amino)His
XSEGTFTSDYSKYLDEQAAKEFIAWLMNT

SEQ ID NO: 168 - protein, 29 aa, Artificial Sequence
  glucagon analog
  MISC_FEATURE: c-term amidation; lactam ring between side chains at positions 16 and 20
  MOD_RES (1)..(1): (Des-amino)His
XSEGTFTSDYSKYLDEQAAKEFIAWLMNT

SEQ ID NO: 169 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLVKG

SEQ ID NO: 170 - protein, 29 aa, Artificial Sequence
  glucagon analog
  MISC_FEATURE: c-term amidation; lactam ring between side chains at positions 12 and 16
  MOD_RES (1)..(1): (Des-amino)His
XSEGTFTSDYSKYLDEQAAKEFIAWLVKG

SEQ ID NO: 171 - protein, 29 aa, Artificial Sequence
  glucagon analog
  MISC_FEATURE: c-term amidation; lactam ring between side chains at positions 16 and 20
  MOD_RES (1)..(1): (Des-amino)His
XSEGTFTSDYSKYLDEQAAKEFIAWLVKG

SEQ ID NO: 172 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAQDFVQWLMNT

SEQ ID NO: 173 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAKDFVQWLMNT

SEQ ID NO: 174 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXEGTFTSDYSKYLDERRAKDFVQWLMNT

SEQ ID NO: 175 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXEGTFTSDYSKYLDERRAQDFVQWLMNT

SEQ ID NO: 176 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXEGTFTSDYSKYLDERRAKDFVQWLMNT

SEQ ID NO: 177 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXEGTFTSDYSKYLDKRRAEDFVQWLMNT

SEQ ID NO: 178 - protein, 29 aa, Artificial Sequence
  glucagon analog
  MISC_FEATURE: c-term amidation
  MOD_RES (2)..(2): Aminoisobutyric acid
HXEGTFTSDYSKYLDERAAKDFVQWLMNT

SEQ ID NO: 179 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXEGTFTSDYSKYLDERAAKDFVQWLMNT

SEQ ID NO: 180 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXEGTFTSDYSKYLDERAAQDFVQWLMNT

SEQ ID NO: 181 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXEGTFTSDYSKYLDERAAKDFVQWLMNT

SEQ ID NO: 182 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXEGTFTSDYSKYLDKRAAEDFVQWLMNT

SEQ ID NO: 183 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLMNT

SEQ ID NO: 184 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXEGTFTSDYSKYLDEQAAKEFIAWLMNT

SEQ ID NO: 185 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXEGTFTSDYSKYLDEQAAKEFIAWLMNT

SEQ ID NO: 186 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLVKG

SEQ ID NO: 187 - protein, 29 aa, Artificial Sequence
  glucagon analog
  MISC_FEATURE: c-term amidation; lactam ring between side chains at positions 12 and 16
  MOD_RES (2)..(2): Aminoisobutyric acid
HXEGTFTSDYSKYLDEQAAKEFIAWLVKG

SEQ ID NO: 188 - protein, 29 aa, Artificial Sequence
  glucagon analog
  MISC_FEATURE: c-term amidation; lactam ring between side chains at positions 16 and 20
  MOD_RES (2)..(2): Aminoisobutyric acid
HXEGTFTSDYSKYLDEQAAKEFIAWLVKG

SEQ ID NO: 189 - protein, 29 aa, Artificial Sequence
  glucagon analog
  MISC_FEATURE: c-term amidation
  MOD_RES (2)..(2): D-Ala
HXEGTFTSDYSKYLDERRAQDFVQWLMNT

SEQ ID NO: 190 - protein, 29 aa, Artificial Sequence
  glucagon analog
  MISC_FEATURE: c-term amidation
  MOD_RES (2)..(2): D-Ala
HXEGTFTSDYSKYLDERRAKDFVQWLMNT

SEQ ID NO: 191 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDERRAKDFVQWLMNT

SEQ ID NO: 192 - protein, 29 aa, Artificial Sequence
  glucagon analog
  MISC_FEATURE: c-term amidation; lactam ring between side chains at positions 12 and 16
  MOD_RES (2)..(2): D-Ala
HXEGTFTSDYSKYLDERRAQDFVQWLMNT

SEQ ID NO: 193 - protein, 29 aa, Artificial Sequence
  glucagon analog
  MISC_FEATURE: c-term amidation; lactam ring between side chains at positions 12 and 16
  MOD_RES (2)..(2): D-Ala
HXEGTFTSDYSKYLDERRAKDFVQWLMNT

SEQ ID NO: 194 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDKRRAEDFVQWLMNT

SEQ ID NO: 195 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDERAAKDFVQWLMNT

SEQ ID NO: 196 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDERAAKDFVQWLMNT

SEQ ID NO: 197 - protein, 29 aa, Artificial Sequence
  glucagon analog
  MISC_FEATURE: c-term amidation; lactam ring between side chains at positions 12 and 16
  MOD_RES (2)..(2): D-Ala
HXEGTFTSDYSKYLDERAAQDFVQWLMNT

SEQ ID NO: 198 - protein, 29 aa, Artificial Sequence
  glucagon analog
  MISC_FEATURE: c-term amidation; lactam ring between side chains at positions 12 and 16
  MOD_RES (2)..(2): D-Ala
HXEGTFTSDYSKYLDERAAKDFVQWLMNT

SEQ ID NO: 199 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDKRAAEDFVQWLMNT

SEQ ID NO: 200 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLMNT

SEQ ID NO: 201 - protein, 29 aa, Artificial Sequence
  glucagon analog
  MISC_FEATURE: c-term amidation; lactam ring between side chains at positions 12 and 16
  MOD_RES (2)..(2): D-Ala
HXEGTFTSDYSKYLDEQAAKEFIAWLMNT

SEQ ID NO: 202 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDEQAAKEFIAWLMNT

SEQ ID NO: 203 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLVKG

SEQ ID NO: 204 - protein, 29 aa, Artificial Sequence
  glucagon analog
  MISC_FEATURE: c-term amidation; lactam ring between side chains at positions 12 and 16
  MOD_RES (2)..(2): D-Ala
HXEGTFTSDYSKYLDEQAAKEFIAWLVKG

SEQ ID NO: 205 - protein, 29 aa, Artificial Sequence
  glucagon analog
  MISC_FEATURE: c-term amidation; lactam ring between side chains at positions 16 and 20
  MOD_RES (2)..(2): D-Ala
HXEGTFTSDYSKYLDEQAAKEFIAWLVKG

SEQ ID NO: 206 - protein, 29 aa, Artificial Sequence
  glucagon analog
  MISC_FEATURE: c-term amidation
  MOD_RES (24)..(24): Cys-PEG
HSQGTFTSDYSKYLDERRAQDFVCWLMNT

SEQ ID NO: 207 - protein, 29 aa, Artificial Sequence
  glucagon analog
  MISC_FEATURE: c-term amidation
  MOD_RES (24)..(24): Cys-PEG
HSQGTFTSDYSKYLDERRAKDFVCWLMNT

SEQ ID NO: 208 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDERRAKDFVCWLMNT

SEQ ID NO: 209 - protein, 29 aa, Artificial Sequence
  glucagon analog
  MISC_FEATURE: c-term amidation; lactam ring between side chains at positions 12 and 16
  MOD_RES (24)..(24): Cys-PEG
HSQGTFTSDYSKYLDERRAQDFVCWLMNT

SEQ ID NO: 210 - protein, 29 aa, Artificial Sequence
  glucagon analog
  MISC_FEATURE: c-term amidation; lactam ring between side chains at positions 12 and 16
  MOD_RES (24)..(24): Cys-PEG
HSQGTFTSDYSKYLDERRAKDFVCWLMNT

SEQ ID NO: 211 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDKRRAEDFVCWLMNT

SEQ ID NO: 212 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDERAAKDFVCWLMNT

SEQ ID NO: 213 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDERAAKDFVCWLMNT

SEQ ID NO: 214 - protein, 29 aa, Artificial Sequence
  glucagon analog
  MISC_FEATURE: c-term amidation; lactam ring between side chains at positions 12 and 16
  MOD_RES (24)..(24): Cys-PEG
HSQGTFTSDYSKYLDERAAQDFVCWLMNT

SEQ ID NO: 215 - protein, 29 aa, Artificial Sequence
  glucagon analog
  MISC_FEATURE: c-term amidation; lactam ring between side chains at positions 12 and 16
  MOD_RES (24)..(24): Cys-PEG
HSQGTFTSDYSKYLDERAAKDFVCWLMNT

SEQ ID NO: 216 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDKRAAEDFVCWLMNT

SEQ ID NO: 217 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLMNT

SEQ ID NO: 218 - protein, 29 aa, Artificial Sequence
  glucagon analog
  MISC_FEATURE: c-term amidation; lactam ring between side chains at positions 12 and 16
  MOD_RES (24)..(24): Cys-PEG
HSQGTFTSDYSKYLDEQAAKEFICWLMNT

SEQ ID NO: 219 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDEQAAKEFICWLMNT

SEQ ID NO: 220 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLVKG

SEQ ID NO: 221 - protein, 29 aa, Artificial Sequence
  glucagon analog
  MISC_FEATURE: c-term amidation; lactam ring between side chains at positions 12 and 16
  MOD_RES (24)..(24): Cys-PEG
HSQGTFTSDYSKYLDEQAAKEFICWLVKG

SEQ ID NO: 222 - protein, 29 aa, Artificial Sequence
  glucagon analog
  MISC_FEATURE: c-term amidation; lactam ring between side chains at positions 16 and 20
  MOD_RES (24)..(24): Cys-PEG
HSQGTFTSDYSKYLDEQAAKEFICWLVKG

SEQ ID NO: 223 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAQDFVCWLMNT

SEQ ID NO: 224 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAKDFVCWLMNT

SEQ ID NO: 225 - protein, 29 aa, Artificial Sequence
  glucagon analog
  MISC_FEATURE: c-term amidation; lactam ring between side chains at positions 16 and 20
  MOD_RES (1)..(1): (Des-amino)His
  MOD_RES (24)..(24): Cys-PEG
XSQGTFTSDYSKYLDERRAKDFVCWLMNT

SEQ ID NO: 226 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDERRAQDFVCWLMNT

SEQ ID NO: 227 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDERRAKDFVCWLMNT

SEQ ID NO: 228 - protein, 29 aa, Artificial Sequence
  glucagon analog
  MISC_FEATURE: c-term amidation; lactam ring between side chains at positions 16 and 20
  MOD_RES (1)..(1): (Des-amino)His
  MOD_RES (24)..(24): Cys-PEG
XSQGTFTSDYSKYLDKRRAEDFVCWLMNT

SEQ ID NO: 229 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERAAKDFVCWLMNT

SEQ ID NO: 230 - protein, 29 aa, Artificial Sequence
  glucagon analog
  MISC_FEATURE: c-term amidation; lactam ring between side chains at positions 16 and 20
  MOD_RES (1)..(1): (Des-amino)His
  MOD_RES (24)..(24): Cys-PEG
XSQGTFTSDYSKYLDERAAKDFVCWLMNT

SEQ ID NO: 231 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys0PEG
XSQGTFTSDYSKYLDERAAQDFVCWLMNT

SEQ ID NO: 232 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDERAAKDFVCWLMNT

SEQ ID NO: 233 - protein, 29 aa, Artificial Sequence
  glucagon analog
  MISC_FEATURE: c-term amidation; lactam ring between side chains at positions 16 and 20
  MOD_RES (1)..(1): (Des-amino)His
  MOD_RES (24)..(24): Cys-PEG
XSQGTFTSDYSKYLDKRAAEDFVCWLMNT

SEQ ID NO: 234 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLMNT

SEQ ID NO: 235 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDEQAAKEFICWLMNT

SEQ ID NO: 236 - protein, 29 aa, Artificial Sequence
  glucagon analog
  MISC_FEATURE: c-term amidation; lactam ring between side chains at positions 16 and 20
  MOD_RES (1)..(1): (Des-amino)His
  MOD_RES (24)..(24): Cys-PEG
XSQGTFTSDYSKYLDEQAAKEFICWLMNT

SEQ ID NO: 237 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLVKG

SEQ ID NO: 238 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDEQAAKEFICWLVKG

SEQ ID NO: 239 - protein, 29 aa, Artificial Sequence
  glucagon analog
  MISC_FEATURE: c-term amidation; lactam ring between side chains at positions 16 and 20
  MOD_RES (1)..(1): (Des-amino)His
  MOD_RES (24)..(24): Cys-PEG
XSQGTFTSDYSKYLDEQAAKEFICWLVKG

SEQ ID NO: 240 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAQDFVCWLMNT

SEQ ID NO: 241 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNT

SEQ ID NO: 242 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
  MOD_RES (24)..(24): Cys-PEG
HXQGTFTSDYSKYLDERRAKDFVCWLMNT

SEQ ID NO: 243 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXQGTFTSDYSKYLDERRAQDFVCWLMNT

SEQ ID NO: 244 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXQGTFTSDYSKYLDERRAKDFVCWLMNT

SEQ ID NO: 245 - protein, 29 aa, Artificial Sequence
  Synthetic peptide
  MISC_FEATURE: c-term amidation; lactam ring side chains at positions 16 and 20
  MOD_RES (2)..(2): Aminoisobutyric acid
  MOD_RES (24)..(24): Cys-PEG
HXQGTFTSDYSKYLDKRRAEDFVCWLMNT

SEQ ID NO: 246 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 247 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
  MOD_RES (24)..(24): Cys-PEG
HXQGTFTSDYSKYLDERAAKDFVCWLMNT

SEQ ID NO: 248 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXQGTFTSDYSKYLDERAAQDFVCWLMNT

SEQ ID NO: 249 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXQGTFTSDYSKYLDERAAKDFVCWLMNT

SEQ ID NO: 250 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXQGTFTSDYSKYLDKRAAEDFVCWLMNT

SEQ ID NO: 251 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 252 - protein, 29 aa, Artificial Sequence
  Synthetic peptide
  misc_feature (2)..(2): Xaa can be any naturally occurring amino acid
HXQGTFTSDYSKYLDEQAAKEFICWLMNT

SEQ ID NO: 253 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
  MOD_RES (24)..(24): Cys-PEG
HXQGTFTSDYSKYLDEQAAKEFICWLMNT

SEQ ID NO: 254 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLVKG

SEQ ID NO: 255 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXQGTFTSDYSKYLDEQAAKEFICWLVKG

SEQ ID NO: 256 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
  MOD_RES (24)..(24): Cys-PEG
HXQGTFTSDYSKYLDEQAAKEFICWLVKG

SEQ ID NO: 257 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAQDFVCWLMNT

SEQ ID NO: 258 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAKDFVCWLMNT

SEQ ID NO: 259 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXQGTFTSDYSKYLDERRAKDFVCWLMNT

SEQ ID NO: 260 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDERRAQDFVCWLMNT

SEQ ID NO: 261 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDERRAKDFVCWLMNT

SEQ ID NO: 262 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXQGTFTSDYSKYLDKRRAEDFVCWLMNT

SEQ ID NO: 263 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERAAKDFVCWLMNT

SEQ ID NO: 264 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXQGTFTSDYSKYLDERAAKDFVCWLMNT

SEQ ID NO: 265 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDERAAQDFVCWLMNT

SEQ ID NO: 266 - protein, 29 aa, Artificial Sequence
  Synthetic peptide
  MISC_FEATURE: c-term amidation; lactam ring betwee side chains at positions 12 and 16
  MOD_RES (2)..(2): D-Ala
  MOD_RES (24)..(24): Cys-PEG
HXQGTFTSDYSKYLDERAAKDFVCWLMNT

SEQ ID NO: 267 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXQGTFTSDYSKYLDKRAAEDFVCWLMNT

SEQ ID NO: 268 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLMNT

SEQ ID NO: 269 - protein, 29 aa, Artificial Sequence
  Synthetic peptide
  MISC_FEATURE: c-term amidation; lactam ring betwee side chains at positions 12 and 16
  MOD_RES (2)..(2): D-Ala
  MOD_RES (24)..(24): Cys-PEG
HXQGTFTSDYSKYLDEQAAKEFICWLMNT

SEQ ID NO: 270 - protein, 29 aa, Artificial Sequence
  Synthetic peptide
  MISC_FEATURE: c-term amidation; lactam ring betwee side chains at positions 16 and 20
  MOD_RES (2)..(2): D-Ala
  MOD_RES (24)..(24): Cys-PEG
HXQGTFTSDYSKYLDEQAAKEFICWLMNT

SEQ ID NO: 271 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLVKG

SEQ ID NO: 272 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDEQAAKEFICWLVKG

SEQ ID NO: 273 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXQGTFTSDYSKYLDEQAAKEFICWLVKG

SEQ ID NO: 274 - protein, 29 aa, Artificial Sequence
  Synthetic peptide
  MISC_FEATURE: c-term amidation
  MOD_RES (24)..(24): Cys-PEG
HSEGTFTSDYSKYLDERRAQDFVCWLMNT

SEQ ID NO: 275 - protein, 29 aa, Artificial Sequence
  Synthetic peptide
  MISC_FEATURE: c-term amidation
  MOD_RES (24)..(24): Cys-PEG
HSEGTFTSDYSKYLDERRAKDFVCWLMNT

SEQ ID NO: 276 - protein, 29 aa, Artificial Sequence
  Synthetic peptide
  MISC_FEATURE: c-term amidation; lactam ring between side chains at positions 16 and 20
  MOD_RES (24)..(24): Cys-PEG
HSEGTFTSDYSKYLDERRAKDFVCWLMNT

SEQ ID NO: 277 - protein, 29 aa, Artificial Sequence
  Synthetic peptide
  MISC_FEATURE: c-term amidation; lactam ring between side chains at positions 12 and 16
  MOD_RES (24)..(24): Cys-PEG
HSEGTFTSDYSKYLDERRAQDFVCWLMNT

SEQ ID NO: 278 - protein, 29 aa, Artificial Sequence
  Synthetic peptide
  MISC_FEATURE: c-term amidation; lactam ring between side chains at positions 12 and 16
  MOD_RES (24)..(24): Cys-PEG
HSEGTFTSDYSKYLDERRAKDFVCWLMNT

SEQ ID NO: 279 - protein, 29 aa, Artificial Sequence
  Synthetic peptide
  MISC_FEATURE: c-term amidation; lactam ring between side chains at positions 16 and 20
  MOD_RES (24)..(24): Cys-PEG
HSEGTFTSDYSKYLDKRRAEDFVCWLMNT

SEQ ID NO: 280 - protein, 29 aa, Artificial Sequence
  Synthetic peptide
  MISC_FEATURE: c-term amidation
  MOD_RES (24)..(24): Cys-PEG
HSEGTFTSDYSKYLDERAAKDFVCWLMNT

SEQ ID NO: 281 - protein, 29 aa, Artificial Sequence
  Synthetic peptide
  MISC_FEATURE: c-term amidation; lactam ring between side chains at positions 16 and 20
  MOD_RES (24)..(24): Cys-PEG
HSEGTFTSDYSKYLDERAAKDFVCWLMNT

SEQ ID NO: 282 - protein, 29 aa, Artificial Sequence
  Synthetic peptide
  MISC_FEATURE: c-term amidation; lactam ring between side chains at positions 12 and 16
  MOD_RES (24)..(24): Cys-PEG
HSEGTFTSDYSKYLDERAAQDFVCWLMNT

SEQ ID NO: 283 - protein, 29 aa, Artificial Sequence
  Synthetic peptide
  MISC_FEATURE: c-term amidation; lactam ring between side chains at positions 12 and 16
  MOD_RES (24)..(24): Cys-PEG
HSEGTFTSDYSKYLDERAAKDFVCWLMNT

SEQ ID NO: 284 - protein, 29 aa, Artificial Sequence
  Synthetic peptide
  MISC_FEATURE: c-term amidation; lactam ring between side chains at positions 16 and 20
  MOD_RES (24)..(24): Cys-PEG
HSEGTFTSDYSKYLDKRAAEDFVCWLMNT

SEQ ID NO: 285 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLMNT

SEQ ID NO: 286 - protein, 29 aa, Artificial Sequence
  Synthetic peptide
  MISC_FEATURE: c-term amidation; lactam ring between side chains at positions 12 and 16
  MOD_RES (24)..(24): Cys-PEG
HSEGTFTSDYSKYLDEQAAKEFICWLMNT

SEQ ID NO: 287 - protein, 29 aa, Artificial Sequence
  Synthetic peptide
  MISC_FEATURE: c-term amidation; lactam ring between side chain at positions 16 and 20
  MOD_RES (24)..(24): Cys-PEG
HSEGTFTSDYSKYLDEQAAKEFICWLMNT

SEQ ID NO: 288 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLVKG

SEQ ID NO: 289 - protein, 29 aa, Artificial Sequence
  Synthetic peptide
  MISC_FEATURE: c-term amidation; lactam ring between side chains at positions 12 and 16
  MOD_RES (24)..(24): Cys-PEG
HSEGTFTSDYSKYLDEQAAKEFICWLVKG

SEQ ID NO: 290 - protein, 29 aa, Artificial Sequence
  Synthetic peptide
  MISC_FEATURE: c-term amidation; lactam ring between side chains at positions 16 and 20
  MOD_RES (24)..(24): Cys-PEG
HSEGTFTSDYSKYLDEQAAKEFICWLVKG

SEQ ID NO: 291 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAQDFVCWLMNT

SEQ ID NO: 292 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAKDFVCWLMNT

SEQ ID NO: 293 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
  MOD_RES (24)..(24): Cys-PEG
XSEGTFTSDYSKYLDERRAKDFVCWLMNT

SEQ ID NO: 294 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
  MOD_RES (24)..(24): Cys-PEG
XSEGTFTSDYSKYLDERRAQDFVCWLMNT

SEQ ID NO: 295 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
  MOD_RES (24)..(24): Cys-PEG
XSEGTFTSDYSKYLDERRAKDFVCWLMNT

SEQ ID NO: 296 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
  MOD_RES (24)..(24): Cys-PEG
XSEGTFTSDYSKYLDKRRAEDFVCWLMNT

SEQ ID NO: 297 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERAAKDFVCWLMNT

SEQ ID NO: 298 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
  MOD_RES (24)..(24): Cys-PEG
XSEGTFTSDYSKYLDERAAKDFVCWLMNT

SEQ ID NO: 299 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
  MOD_RES (24)..(24): Cys-PEG
XSEGTFTSDYSKYLDERAAQDFVCWLMNT

SEQ ID NO: 300 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
  MOD_RES (24)..(24): Cys-PEG
XSEGTFTSDYSKYLDERAAKDFVCWLMNT

SEQ ID NO: 301 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
  MOD_RES (24)..(24): Cys-PEG
XSEGTFTSDYSKYLDKRAAEDFVCWLMNT

SEQ ID NO: 302 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDEQAAKGFICWLMNT

SEQ ID NO: 303 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
  MOD_RES (24)..(24): Cys-PEG
XSEGTFTSDYSKYLDEQAAKGFICWLMNT

SEQ ID NO: 304 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
  MOD_RES (24)..(24): Cys-PEG
XSEGTFTSDYSKYLDEQAAKGFICWLMNT

SEQ ID NO: 305 - protein, 29 aa, Artificial Sequence
  Synthetic peptide
  MISC_FEATURE: c-term amidation
  MOD_RES (1)..(1): (des-amino)His
  MOD_RES (24)..(24): Cys-PEG
XSEGTFTSDYSKYLDEQAAKGFICWLVKG

SEQ ID NO: 306 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
  MOD_RES (24)..(24): Cys-PEG
XSEGTFTSDYSKYLDEQAAKGFICWLVKG

SEQ ID NO: 307 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
  MOD_RES (24)..(24): Cys-PEG
XSEGTFTSDYSKYLDEQAAKGFICWLVKG

SEQ ID NO: 308 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAQDFVCWLMNT

SEQ ID NO: 309 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAKDFVCWLMNT

SEQ ID NO: 310 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
  MOD_RES (24)..(24): Cys-PEG
HXEGTFTSDYSKYLDERRAKDFVCWLMNT

SEQ ID NO: 311 - protein, 29 aa, Artificial Sequence
  Synthetic peptide
  MISC_FEATURE: c-term amidation; lactam ring between side chain at positions 12 and 16
  MOD_RES (2)..(2): Aminoisobutyric acid
  MOD_RES (24)..(24): Cys-PEG
HXEGTFTSDYSKYLDERRAQDFVCWLMNT

SEQ ID NO: 312 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXEGTFTSDYSKYLDERRAKDFVCWLMNT

SEQ ID NO: 313 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
  MOD_RES (24)..(24): Cys-PEG
HXEGTFTSDYSKYLDKRRAEDFVCWLMNT

SEQ ID NO: 314 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERAAKDFVCWLMNT

SEQ ID NO: 315 - protein, 29 aa, Artificial Sequence
  Synthetic peptide
  MISC_FEATURE: c-term amidation; lactam ring between seide chains at positions 16 and 20
  MOD_RES (2)..(2): Aminoisobutyric acid
  MOD_RES (24)..(24): Cys-PEG
HXEGTFTSDYSKYLDERAAKDFVCWLMNT

SEQ ID NO: 316 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXEGTFTSDYSKYLDERAAQDFVCWLMNT

SEQ ID NO: 317 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXEGTFTSDYSKYLDERAAKDFVCWLMNT

SEQ ID NO: 318 - protein, 29 aa, Artificial Sequence
  Synthetic peptide
  MOD_RES (2)..(2): Aminoisobutyric acid
  MOD_RES (24)..(24): Cys-PEG
  MISC_FEATURE (24)..(24): c-term amidation; lactam ring between side chains at positions 16 and 20
HXEGTFTSDYSKYLDKRAAEDFVCWLMNT

SEQ ID NO: 319 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLMNT

SEQ ID NO: 320 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXEGTFTSDYSKYLDEQAAKEFICWLMNT

SEQ ID NO: 321 - protein, 29 aa, Artificial Sequence
  Synthetic peptide
  MISC_FEATURE: c-term amidation; lactam ring between side chains at position 16 and 20
  MOD_RES (2)..(2): Aminoisobutyric acid
  MOD_RES (24)..(24): Cys-PEG
HXEGTFTSDYSKYLDEQAAKEFICWLMNT

SEQ ID NO: 322 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLVKG

SEQ ID NO: 323 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
  MOD_RES (24)..(24): Cys-PEG
HXEGTFTSDYSKYLDEQAAKEFICWLVKG

SEQ ID NO: 324 - protein, 29 aa, Artificial Sequence
  Synthetic peptide
  MISC_FEATURE: c-term amidation; lactam ring between side chains at position 16 and 20
  MOD_RES (2)..(2): Aminoisobutyric acid
  MOD_RES (24)..(24): Cys-PEG
HXEGTFTSDYSKYLDEQAAKEFICWLVKG

SEQ ID NO: 325 - protein, 29 aa, Artificial Sequence
  Synthetic peptide
  MOD_RES (2)..(2): D-Ala
  MOD_RES (24)..(24): Cys-PEG
HXEGTFTSDYSKYLDERRAQDFVCWLMNT

SEQ ID NO: 326 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAKDFVCWLMNT

SEQ ID NO: 327 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXEGTFTSDYSKYLDERRAKDFVCWLMNT

SEQ ID NO: 328 - protein, 29 aa, Artificial Sequence
  Synthetic peptide
  MISC_FEATURE: c-term amidation; lactam between side chains at positions 12 and 16
  MOD_RES (2)..(2): D-Ala
  MOD_RES (24)..(24): Cys-PEG
HXEGTFTSDYSKYLDERRAQDFVCWLMNT

SEQ ID NO: 329 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXEGTFTSDYSKYLDERRAKDFVCWLMNT

SEQ ID NO: 330 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXEGTFTSDYSKYLDKRRAEDFVCWLMNT

SEQ ID NO: 331 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERAAKDFVCWLMNT

SEQ ID NO: 332 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXEGTFTSDYSKYLDERAAKDFVCWLMNT

SEQ ID NO: 333 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXEGTFTSDYSKYLDERAAQDFVCWLMNT

SEQ ID NO: 334 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXEGTFTSDYSKYLDERAAKDFVCWLMNT

SEQ ID NO: 335 - protein, 29 aa, Artificial Sequence
  Synthetic peptide
  MISC_FEATURE: c-term amidation; lactam ring between side chainst at positions 16 and 20
  MOD_RES (2)..(2): D-Ala
  MOD_RES (24)..(24): Cys-PEG
HXEGTFTSDYSKYLDKRAAEDFVCWLMNT

SEQ ID NO: 336 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLMNT

SEQ ID NO: 337 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXEGTFTSDYSKYLDEQAAKEFICWLMNT

SEQ ID NO: 338 - protein, 29 aa, Artificial Sequence
  Synthetic peptide
  MISC_FEATURE: c-term amidation; lactam right between side chains at positions 16 and 20
  MOD_RES (2)..(2): D-Ala
  MOD_RES (24)..(24): Cys-PEG
HXEGTFTSDYSKYLDEQAAKEFICWLMNT

SEQ ID NO: 339 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLVKG

SEQ ID NO: 340 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXEGTFTSDYSKYLDEQAAKEFICWLVKG

SEQ ID NO: 341 - protein, 29 aa, Artificial Sequence
  Synthetic peptide
  MISC_FEATURE: c-term amidation; lactam ring between side chains at positions 16 and 20
  MOD_RES (2)..(2): D-Ala
  MOD_RES (24)..(24): Cys-PEG
HXEGTFTSDYSKYLDEQAAKEFICWLVKG

SEQ ID NO: 342 - protein, 29 aa, Artificial Sequence
  Synthetic peptide
  MISC_FEATURE: c-term amidation
  MOD_RES (16)..(16): Cys-PEG
HSQGTFTSDYSKYLDCRRAKDFVQWLMNT

SEQ ID NO: 343 - protein, 29 aa, Artificial Sequence
  Synthetic peptide
  MISC_FEATURE: c-term amidation
  MOD_RES (16)..(16): Cys-PEG
HSQGTFTSDYSKYLDCRAAKDFVQWLMNT

SEQ ID NO: 344 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLMNT

SEQ ID NO: 345 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLVKG

SEQ ID NO: 346 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRRAKDFVQWLMNT

SEQ ID NO: 347 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRAAKDFVQWLMNT

SEQ ID NO: 348 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 349 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLVKG

SEQ ID NO: 350 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 351 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCRAAKDFVQWLMNT

SEQ ID NO: 352 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLMNT

SEQ ID NO: 353 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLVKG

SEQ ID NO: 354 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRRAKDFVQWLMNT

SEQ ID NO: 355 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRAAKDFVQWLMNT

SEQ ID NO: 356 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLMNT

SEQ ID NO: 357 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLVKG

SEQ ID NO: 358 - protein, 29 aa, Artificial Sequence
  Synthetic peptide
  MISC_FEATURE: c-term amidation
  MOD_RES (16)..(16): Cys-PEG
HSEGTFTSDYSKYLDCRRAKDFVQWLMNT

SEQ ID NO: 359 - protein, 29 aa, Artificial Sequence
  Synthetic peptide
  MISC_FEATURE: c-term amidation
  MOD_RES (16)..(16): Cys-PEG
HSEGTFTSDYSKYLDCRAAKDFVQWLMNT

SEQ ID NO: 360 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLMNT

SEQ ID NO: 361 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLVKG

SEQ ID NO: 362 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRRAKDFVQWLMNT

SEQ ID NO: 363 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRAAKDFVQWLMNT

SEQ ID NO: 364 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLMNT

SEQ ID NO: 365 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLVKG

SEQ ID NO: 366 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 367 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 368 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 369 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 370 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 371 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 372 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 373 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 374 - protein, 29 aa, Artificial Sequence
  Synthetic peptide
  MISC_FEATURE: c-term amidation
HSQGTFTSDYSKYLDERRAQDFVQWLMDT

SEQ ID NO: 375 - protein, 29 aa, Artificial Sequence
  Synthetic peptide
  MISC_FEATURE: c-term amidation
HSQGTFTSDYSKYLDERRAKDFVQWLMDT

SEQ ID NO: 376 - protein, 29 aa, Artificial Sequence
  Synthetic peptide
  MISC_FEATURE: c-term amidation; lactam ring between side chains at positions 16 and 20
HSQGTFTSDYSKYLDERRAKDFVQWLMDT

SEQ ID NO: 377 - protein, 29 aa, Artificial Sequence
  Synthetic peptide
  MISC_FEATURE: c-term amidation; lactam ring between side chains at positions 12 and 16
HSQGTFTSDYSKYLDERRAQDFVQWLMDT

SEQ ID NO: 378 - protein, 29 aa, Artificial Sequence
  Synthetic peptide
  MISC_FEATURE: c-term amidation; lactam ring between side chains at positions 12 and 16
HSQGTFTSDYSKYLDERRAKDFVQWLMDT

SEQ ID NO: 379 - protein, 29 aa, Artificial Sequence
  Synthetic peptide
  MISC_FEATURE: c-term amidation; lactam ring between side chains at positions 16 and 20
HSQGTFTSDYSKYLDKRRAEDFVQWLMDT

SEQ ID NO: 380 - protein, 29 aa, Artificial Sequence
  Synthetic peptide
  MISC_FEATURE: c-term amidation
HSQGTFTSDYSKYLDERAAKDFVQWLMDT

SEQ ID NO: 381 - protein, 29 aa, Artificial Sequence
  Synthetic peptide
  MISC_FEATURE: c-term amidation; lactam ring between side chains at positions 16 and 20
HSQGTFTSDYSKYLDERAAKDFVQWLMDT

SEQ ID NO: 382 - protein, 29 aa, Artificial Sequence
  Synthetic peptide
  MISC_FEATURE: c-term amidation; lactam ring between side chains at positions 12 and 16
HSQGTFTSDYSKYLDERAAQDFVQWLMDT

SEQ ID NO: 383 - protein, 29 aa, Artificial Sequence
  Synthetic peptide
  MISC_FEATURE: c-term amidation; lactam ring between side chains at positions 12 and 16
HSQGTFTSDYSKYLDERAAKDFVQWLMDT

SEQ ID NO: 384 - protein, 29 aa, Artificial Sequence
  Synthetic peptide
  MISC_FEATURE: c-term amidation; lactam ring between side chains at positions 16 and 20
HSQGTFTSDYSKYLDKRAAEDFVQWLMDT

SEQ ID NO: 385 - protein, 29 aa, Artificial Sequence
  Synthetic peptide
  MISC_FEATURE: c-term amidation
HSQGTFTSDYSKYLDEQAAKEFIAWLMDT

SEQ ID NO: 386 - protein, 29 aa, Artificial Sequence
  Synthetic peptide
  MISC_FEATURE: c-term amidation; lactam ring between side chains at positions 12 and 16
HSQGTFTSDYSKYLDEQAAKEFIAWLMDT

SEQ ID NO: 387 - protein, 29 aa, Artificial Sequence
  Synthetic peptide
  MISC_FEATURE: c-term amidation; lactam ring between side chains at positions 16 and 20
HSQGTFTSDYSKYLDEQAAKEFIAWLMDT

SEQ ID NO: 388 - protein, 29 aa, Artificial Sequence
  Synthetic peptide
  MISC_FEATURE: c-term amidation
  MOD_RES (1)..(1): (Des-amino)His
XSQGTFTSDYSKYLDERRAQDFVQWLMDT

SEQ ID NO: 389 - protein, 29 aa, Artificial Sequence
  Synthetic peptide
  MISC_FEATURE: c-term amidation
  MOD_RES (1)..(1): (Des-amino)His
XSQGTFTSDYSKYLDERRAKDFVQWLMDT

SEQ ID NO: 390 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
XSQGTFTSDYSKYLDERRAKDFVQWLMDT

SEQ ID NO: 391 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
XSQGTFTSDYSKYLDERRAQDFVQWLMDT

SEQ ID NO: 392 - protein, 29 aa, Artificial Sequence
  Synthetic peptide
  misc_feature (1)..(1): Xaa can be any naturally occurring amino acid
XSQGTFTSDYSKYLDERRAKDFVQWLMDT

SEQ ID NO: 393 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
XSQGTFTSDYSKYLDKRRAEDFVQWLMDT

SEQ ID NO: 394 - protein, 29 aa, Artificial Sequence
  Synthetic peptide
  MISC_FEATURE: c-term amidation
  MOD_RES (1)..(1): (Des-amino)His
XSQGTFTSDYSKYLDERAAKDFVQWLMDT

SEQ ID NO: 395 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
XSQGTFTSDYSKYLDERAAKDFVQWLMDT

SEQ ID NO: 396 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
XSQGTFTSDYSKYLDERAAQDFVQWLMDT

SEQ ID NO: 397 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
XSQGTFTSDYSKYLDERAAKDFVQWLMDT

SEQ ID NO: 398 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
XSQGTFTSDYSKYLDKRAAEDFVQWLMDT

SEQ ID NO: 399 - protein, 29 aa, Artificial Sequence
  Synthetic peptide
  MISC_FEATURE: c-term amidation
  MOD_RES (1)..(1): (Des-amino)His
XSQGTFTSDYSKYLDEQAAKEFIAWLMDT

SEQ ID NO: 400 - protein, 29 aa, Artificial Sequence
  Synthetic peptide
  MISC_FEATURE: c-term amidation; lactam ring between side chains at positions 12 and 16
  MOD_RES (1)..(1): (Des-amino)His
XSQGTFTSDYSKYLDEQAAKEFIAWLMDT

SEQ ID NO: 401 - protein, 29 aa, Artificial Sequence
  Synthetic peptide
  MISC_FEATURE: c-term amidation; lactam ring between side chains at positions 16 and 20
  MOD_RES (1)..(1): (Des-amino)His
XSQGTFTSDYSKYLDEQAAKEFIAWLMDT

SEQ ID NO: 402 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAQDFVQWLMDT

SEQ ID NO: 403 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAKDFVQWLMDT

SEQ ID NO: 404 - protein, 29 aa, Artificial Sequence
  Synthetic peptide
  MISC_FEATURE: c-term amidation; lactam ring between side chains at positions 16 and 20
  MOD_RES (2)..(2): Aminoisobutyric acid
HXQGTFTSDYSKYLDERRAKDFVQWLMDT

SEQ ID NO: 405 - protein, 29 aa, Artificial Sequence
  Synthetic peptide
  MISC_FEATURE: c-term amidation; lactam ring between side chains at positions 12 and 16
  MOD_RES (2)..(2): aminoisobutyric acid
HXQGTFTSDYSKYLDERRAQDFVQWLMDT

SEQ ID NO: 406 - protein, 29 aa, Artificial Sequence
  Synthetic peptide
  MISC_FEATURE: c-term amidation; lactam ring between side chains at positions 12 and 16
  MOD_RES (2)..(2): Aminoisobutyric acid
HXQGTFTSDYSKYLDERRAKDFVQWLMDT

SEQ ID NO: 407-533 - skipped (127 entries)

SEQ ID NO: 534 - protein, 29 aa, Artificial Sequence
  Synthetic peptide
  MOD_RES (2)..(2): Aminoisobutyric acid
  MOD_RES (10)..(10): acylated with C8 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 535 - protein, 29 aa, Artificial Sequence
  Synthetic peptide
  MOD_RES (2)..(2): Aminoisobutyric acid
  MOD_RES (10)..(10): acylated with C14 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 536 - protein, 29 aa, Artificial Sequence
  Synthetic peptide
  MOD_RES (2)..(2): Aminoisobutyric acid
  MOD_RES (10)..(10): acylated with C16 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 537 - protein, 29 aa, Artificial Sequence
  Synthetic peptide
  MOD_RES (2)..(2): Aminoisobutyric acid
  MOD_RES (10)..(10): acylated with C18 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 538 - protein, 29 aa, Artificial Sequence
  Synthetic peptide
  MOD_RES (10)..(10): acylated with C18 fatty acid
  MOD_RES (24)..(24): Cys-PEG
  MISC_FEATURE (29)..(29): c-term amidation
HSQGTFTSDKSKYLDEQAAKEFICWLMNT

SEQ ID NO: 539 - protein, 29 aa, Artificial Sequence
  Synthetic peptide
  MOD_RES (10)..(10): acylated with C24 fatty acid
  MOD_RES (24)..(24): Cys-PEG
HSQGTFTSDKSKYLDERRAKDFVCWLMNT

SEQ ID NO: 540 - protein, 29 aa, Artificial Sequence
  Synthetic peptide
  MOD_RES (10)..(10): covalently attached to a Trp residue comprising C18 fatty acid
  MOD_RES (24)..(24): Cys-PEG
HSQGTFTSDKSKYLDERRAKDFVCWLMNT

SEQ ID NO: 541 - protein, 29 aa, Artificial Sequence
  Synthetic peptide
  MOD_RES (10)..(10): covalently attached to a Trp residue comprising C16 fatty acid
  MOD_RES (24)..(24): Cys-PEG
HSQGTFTSDKSKYLDERRAKDFVCWLMNT

SEQ ID NO: 542 - protein, 29 aa, Artificial Sequence
  Synthetic peptide
  MOD_RES (10)..(10): covalent attache to C16 fatty acid
HSQGTFTSDKSKYLDERRAKDFVQWLMNT

SEQ ID NO: 543 - protein, 29 aa, Artificial Sequence
  Synthetic peptide
  MOD_RES (10)..(10): covalently attached to a Trp residue comprising C16 fatty acid
HSQGTFTSDKSKYLDERRAKDFVQWLMNT

SEQ ID NO: 544 - protein, 29 aa, Artificial Sequence
  Synthetic peptide
  MOD_RES (10)..(10): covalently attached to C18 fatty acid
HSQGTFTSDKSKYLDERRAKDFVQWLMNT

SEQ ID NO: 545 - protein, 29 aa, Artificial Sequence
  Synthetic peptide
  MISC_FEATURE: c-term amidation
HSQGTFTSDYSKYLDERRAKDFVQWLMNT

SEQ ID NO: 546 - protein, 29 aa, Artificial Sequence
  Synthetic peptide
  MOD_RES (10)..(10): covalently attached to a Trp residue comprising C16 fatty acid
  MOD_RES (24)..(24): Cys-PEG
HSQGTFTSDKSKYLDERRAKDFVCWLMNT

SEQ ID NO: 547 - protein, 29 aa, Artificial Sequence
  Synthetic peptide
  MOD_RES (10)..(10): covalently attached to a C18 fatty acid
  MOD_RES (24)..(24): Cys-PEG
HSQGTFTSDKSKYLDERRAKDFVCWLMNT

SEQ ID NO: 548 - protein, 29 aa, Artificial Sequence
  Synthetic peptide
  MOD_RES (10)..(10): covalently attached to a Trp residue comprising a C18 fatty acid
  MOD_RES (24)..(24): Cys-PEG
HSQGTFTSDKSKYLDERRAKDFVCWLMNT

SEQ ID NO: 549 - protein, 29 aa, Artificial Sequence
  Synthetic peptide
  MOD_RES (10)..(10): attached to a Glu residue comprising a C16 fatty acid
  MOD_RES (24)..(24): Cys-PEG
  MISC_FEATURE (29)..(29): c-term amidation
HSQGTFTSDKSKYLDERRAQDFVCWLMNT

SEQ ID NO: 550 - protein, 28 aa, Artificial Sequence
  Synthetic peptide
HSQGTFTSDYSKYLDEQAAKEFIAWLMN

SEQ ID NO: 551 - protein, 27 aa, Artificial Sequence
  Synthetic peptide
HSQGTFTSDYSKYLDEQAAKEFIAWLM

SEQ ID NO: 552 - protein, 28 aa, Artificial Sequence
  Synthetic peptide
  MISC_FEATURE (28)..(28): c-term amidation
HSQGTFTSDYSKYLDERRAKDFVQWLMN

SEQ ID NO: 553 - protein, 27 aa, Artificial Sequence
  Synthetic peptide
  MISC_FEATURE (27)..(27): c-term amidation
HSQGTFTSDYSKYLDERRAKDFVQWLM

SEQ ID NO: 554 - protein, 29 aa, Artificial Sequence
  Synthetic peptide
  MOD_RES (27)..(27): Nle
  MISC_FEATURE (29)..(29): c-term amidation
HSEGTFTSDYSKYLDEQAAKEFIAWLXNT

SEQ ID NO: 555 - protein, 39 aa, Artificial Sequence
  Synthetic peptide
  MISC_FEATURE: lactam ring between side chains at positions 16 and 20
YSQGTFTSDYSKYLDEQAAKEFVNWLMNGGPSSGAPPPS

SEQ ID NO: 556 - protein, 29 aa, Artificial Sequence
  Synthetic peptide
  MOD_RES (16)..(16): Aminoisobutyric acid
  MISC_FEATURE (29)..(29): c-term amidation
HSQGTFTSDYSKYLDXQAAKEFIAWLMNT

SEQ ID NO: 557 - protein, 31 aa, Artificial Sequence
  Synthetic peptide
  MOD_RES (2)..(2): Aminoisobutyric acid
  MISC_FEATURE (29)..(29): c-term amidation
HXQGTFTSDYSKYLDAIBRRAQDFVQWLMNT

SEQ ID NO: 558 - protein, 31 aa, Artificial Sequence
  Synthetic peptide
  MOD_RES (2)..(2): Aminoisobutyric acid
  MOD_RES (10)..(10): attached to a Trp comprising a C16 fatty acid
  MOD_RES (24)..(24): Cys-PEG
  MISC_FEATURE (29)..(29): c-term amidation
HXQGTFTSDKSKYLDAIBRRAQDFVCWLMNT

SEQ ID NO: 559 - protein, 31 aa, Artificial Sequence; identical to SEQ ID NO: 558
  Synthetic peptide
  MOD_RES (2)..(2): Aminoisobutyric acid

SEQ ID NO: 560 - protein, 33 aa, Artificial Sequence
  Synthetic peptide
  MOD_RES (2)..(2): Aminoisobutyric acid
  MOD_RES (10)..(10): attached to a Trp comprising a C16 fatty acid
  MOD_RES (24)..(24): Cys-PEG
  MISC_FEATURE (29)..(29): c-term amidation
HXQGTFTSDKSKYLDAIBRRAAIBDFVCWLMNT

SEQ ID NO: 561 - protein, 33 aa, Artificial Sequence; identical to SEQ ID NO: 560
  Synthetic peptide
  MOD_RES (2)..(2): Aminoisobutyric acid
  MOD_RES (10)..(10): attached to a Trp comprising a C16 fatty acid
  MOD_RES (29)..(29): c-term amidation

SEQ ID NO: 562-600 - skipped (39 entries)

SEQ ID NO: 601 - protein, 31 aa, Homo sapiens; identical to SEQ ID NO: 50
  MISC_FEATURE: GLP-1 (7-37)
  MOD_RES (31)..(31): C-terminal carboxylate replaced with amide

SEQ ID NO: 602 - protein, 30 aa, Homo sapiens; identical to SEQ ID NO: 52
  MOD_RES (30)..(30): C-terminal carboxylate replaced with amide

SEQ ID NO: 603 - protein, 26 aa, Homo sapiens
FTSDVSSYLEGQAAKEFIAWLVKGRG

SEQ ID NO: 604 - protein, 26 aa, Homo sapiens
  MOD_RES (25)..(25): AMIDATION
FTSDVSSYLEGQAAKEFIAWLVKGAR

SEQ ID NO: 605 - protein, 34 aa, Homo sapiens
  MOD_RES (25)..(25): Xaa at position 25 is Arg or Gly
  MOD_RES (34)..(34): AMIDATION
FTSDVSSYLEGQAAKEFIAWLVKGXPSSGAPPPS

SEQ ID NO: 606 - protein, 34 aa, Homo sapiens
FTSDVSSYLEGQAAKEFIAWLVKGRGKRNRNNIA

SEQ ID NO: 607 - protein, 39 aa, Homo sapiens
  MOD_RES (1)..(1): Hydroxyl group replacing the native N-terminal amine
  MOD_RES (30)..(30): Xaa at position 30 is Arg or Gly
  MOD_RES (39)..(39): AMIDATION
FAEGTFTSDVSSYLEGQAAKEFIAWLVKGXPSSGAPPPS

SEQ ID NO: 608 - protein, 38 aa, Homo sapiens
  MOD_RES (29)..(29): Xaa at position 29 is Arg or Gly
  MOD_RES (38)..(38): AMIDATION
AEGTFTSDVSSYLEGQAAKEFIAWLVKGXPSSGAPPPS

SEQ ID NO: 609 - protein, 38 aa, Homo sapiens
  MOD_RES (29)..(29): Xaa at position 29 is Arg or Gly
  MOD_RES (38)..(38): AMIDATION
AQGTFTSDVSSYLEGQAAKEFIAWLVKGXPSSGAPPPS

SEQ ID NO: 610 - protein, 39 aa, Homo sapiens
HAEGTFTSDVSSYLEGQAAKEFIAWLVKGRGKRNRNNIA

SEQ ID NO: 611 - protein, 39 aa, Homo sapiens
  MOD_RES (30)..(30): Xaa at position 30 is Arg or Gly
  MOD_RES (39)..(39): AMIDATION
HAEGTFTSDVSSYLEGQAAKEFIAWLVKGXPSSGAPPPS

SEQ ID NO: 612 - protein, 29 aa, Homo sapiens
  MISC_FEATURE: Glucagon
HSQGTFTSDYSKYLDSRRAQDFVQWLMNT

SEQ ID NO: 613 - protein, 21 aa, Homo sapiens
GIVEQCCTSICSLYQLENYCN

SEQ ID NO: 614 - protein, 30 aa, Homo sapiens
FVNQHLCGSHLVEALYLVCGERGFFYTPKT

SEQ ID NO: 615 - protein, 26 aa, Homo sapiens
  MOD_RES (11)..(11): Xaa at position 11 is serine, glycine, glutamic acid, glutamine, homoglutamic acid or homocysteic acid
  MOD_RES (15)..(15): Xaa at position 15 is Lys, Cys, Orn, homocysteine or acetyl phenyalanine
  MOD_RES (16)..(16): Xaa at position 16 is Glu, Cys, Orn, homocysteine or acetyl phenyalanine
  MOD_RES (19)..(19): Xaa at position 19 is Ala, Cys, Orn, homocysteine or acetyl phenyalanine
FTSDVSSYLEXQAAXXFIXWLVKGRG

SEQ ID NO: 616 - protein, 25 aa, Homo sapiens
  MOD_RES (11)..(11): Xaa at position 11 is serine, glycine, glutamic acid, glutamine, homoglutamic acid or homocysteic acid
  MOD_RES (15)..(15): Xaa at position 15 is Lys, Cys, Orn, homocysteine or acetyl phenyalanine
  MOD_RES (16)..(16): Xaa at position 16 is Glu, Cys, Orn, homocysteine or acetyl phenyalanine
  MOD_RES (19)..(19): Xaa at position 19 is Ala, Cys, Orn, homocysteine or acetyl phenyalanine
FTSDVSSYLEXQAAXXFIXWLVKGR

SEQ ID NO: 617 - protein, 35 aa, Homo sapiens
  MOD_RES (11)..(11): Xaa at position 11 is serine, glycine, glutamic acid, glutamine, homoglutamic acid or homocysteic acid
  MOD_RES (15)..(15): Xaa at position 15 is Lys, Cys, Orn, homocysteine or acetyl phenyalanine
  MOD_RES (16)..(16): Xaa at position 16 is Glu, Cys, Orn, homocysteine or acetyl phenyalanine
  MOD_RES (19)..(19): Xaa at position 19 is Ala, Cys, Orn, homocysteine or acetyl phenyalanine
  MOD_RES (25)..(25): Xaa at position 25 is Arg or Gly
  MOD_RES (35)..(35): AMIDATION
  MOD_RES (35)..(35): Xaa at position 35 is Cys, Orn, homocysteine or acetyl phenyalanine
FTSDVSSYLEXQAAXXFIXWLVKGXPSSGAPPPSX

SEQ ID NO: 618 - protein, 24 aa, Homo sapiens
  MOD_RES (11)..(11): Xaa at position 11 is serine, glycine, glutamic acid, glutamine, homoglutamic acid or homocysteic acid
  MOD_RES (15)..(15): Xaa at position 15 is Gln, Cys, Orn, homocysteine or acetyl phenyalanine
  MOD_RES (16)..(16): Xaa at position 16 is Asp, Cys, Orn, homocysteine or acetyl phenyalanine
  MOD_RES (19)..(19): Xaa at position 19 is Gln, Cys, Orn, homocysteine or acetyl phenyalanine
FTSDYSKYLDXRRAXXFVXWLMNT

SEQ ID NO: 619 - protein, 35 aa, Homo sapiens
  MOD_RES (11)..(11): Xaa at position 11 is serine, glycine, glutamic acid, glutamine, homoglutamic acid or homocysteic acid
  MOD_RES (15)..(15): Xaa at position 15 is Gln, Cys, Orn, homocysteine or acetyl phenyalanine
  MOD_RES (16)..(16): Xaa at position 16 is Asp, Cys, Orn, homocysteine or acetyl phenyalanine
  MOD_RES (19)..(19): Xaa at position 19 is Gln, Cys, Orn, homocysteine or acetyl phenyalanine
  MOD_RES (35)..(35): AMIDATION
  MOD_RES (35)..(35): Xaa at position 35 is Cys, Orn, homocysteine or acetyl phenyalanine
FTSDYSKYLDXRRAXXFVXWLMNTGPSSGAPPPSX

SEQ ID NO: 620 - protein, 34 aa, Homo sapiens
  MOD_RES (34)..(34): AMIDATION
FTSDYSKYLDSRRAQDFVQWLMNTGPSSGAPPPS

SEQ ID NO: 621 - protein, 4 aa, Homo sapiens
  MOD_RES (1)..(1): Xaa at position 1 is histidine, desaminohistidine, homo-histidine, tyrosine or phenylalanine
  MOD_RES (2)..(2): Xaa at position 2 is glycine, alanine, serine, valine, d-alanine, aminoisobutyric acid, or N-methyl alanine
  MOD_RES (3)..(3): Xaa at position 3 is glutamic acid, aspartic acid, glutamine or asparagine
XXXG

SEQ ID NO: 622 - protein, 29 aa, Homo sapiens
  MOD_RES (1)..(1): Xaa at position 1 is histidine, desaminohistidine, homo-histidine, tyrosine or phenylalanine
  MOD_RES (2)..(2): Xaa at position 2 is glycine, alanine, serine, valine, D-alanine, aminoisobutyric acid, or N-methyl alanine
  MOD_RES (3)..(3): Xaa at position 3 is glutamic acid, aspartic acid, glutamine or asparagine
  MOD_RES (5)..(5): Xaa at position 5 is threonine or serine
  MOD_RES (8)..(8): Xaa at position 8 is threonine or serine
  MOD_RES (11)..(11): Xaa at position 11 is threonine or serine
  MOD_RES (16)..(16): Xaa at position 16 is glycine, glutamic acid, glutamine, homoglutamic acid or homocysteic acid
  MOD_RES (20)..(20): Xaa at position 20 is Lys, Cys, Orn, homocysteine or acetyl phenyalanine
  MOD_RES (21)..(21): Xaa at position 21is Glu, Cys, Orn, homocysteine or acetyl phenyalanine
  MOD_RES (24)..(24): Xaa at position 24 is Ala, Cys, Orn, homocysteine or acetyl phenyalanine
XXXGXFTXDVXSYLEXQAAXXFIXWLVKG

SEQ ID NO: 623 - protein, 29 aa, Homo sapiens
  MOD_RES (1)..(1): Xaa at position 1 is histidine, desaminohistidine, homo-histidine, tyrosine or phenylalanine
  MOD_RES (2)..(2): Xaa at position 2 is glycine, alanine, serine, valine, D-alanine, aminoisobutyric acid, N-methyl alanine
  MOD_RES (3)..(3): Xaa at position 3 is glutamic acid, aspartic acid, glutamine or asparagine
  MOD_RES (5)..(5): Xaa at position 5 is serine or threonine
  MOD_RES (8)..(8): Xaa at position 8 is serine or threonine
  MOD_RES (11)..(11): Xaa at position 8 is serine or threonine
  MOD_RES (16)..(16): Xaa at position 16 is serine, glycine, glutamic acid, glutamine, homoglutamic acid or homocysteic acid
  MOD_RES (20)..(20): Xaa at position 20 is Gln, Cys, Orn, homocysteine or acetyl phenyalanine
  MOD_RES (21)..(21): Xaa at position 21 is Asp, Cys, Orn, homocysteine or acetyl phenyalanine
  MOD_RES (24)..(24): Xaa at position 24 is Gln, Cys, Orn, homocysteine or acetyl phenyalanine
XXXGXFTXDYXKYLDXRRAXXFVXWLMNT

SEQ ID NO: 624 - protein, 10 aa, Homo sapiens
GPSSGAPPPS

SEQ ID NO: 625 - protein, 8 aa, Homo sapiens
KRNRNNIA

SEQ ID NO: 626 - protein, 21 aa, Homo sapiens
  MOD_RES (1)..(1): Xaa at position 1 is Gly or desamino-Gly
  MOD_RES (4)..(4): Xaa at position 4 is Glu Ser or Thr
  MOD_RES (8)..(8): Xaa at position 8 is Thr, His, Arg or Lys
  MOD_RES (21)..(21): Xaa at position 21 is Asn, Ser, Thr or Gly
XIVXQCCXSICSLYQLENYCX

SEQ ID NO: 627 - protein, 30 aa, Homo sapiens
  MOD_RES (1)..(1): Xaa at position 1 is Phe or desamino-Phe
  MOD_RES (5)..(5): Xaa at position 5 is His, Thr or Ser
  MOD_RES (9)..(9): Xaa at position 9 is Thr or Ser
  MOD_RES (10)..(10): Xaa at position 10 is Asp, Glu, homocysteic acid or cysteic acid
  MOD_RES (16)..(16): Xaa at position 16 is Tyr or  4-hydroxymethyl Phe
  MOD_RES (25)..(25): Xaa at position 25 is Tyr, Phe or  4-hydroxymethyl Phe
XVNQXLCGXXLVEALXLVCGERGFXYTPKT

SEQ ID NO: 628 - protein, 21 aa, Homo sapiens
  MOD_RES (1)..(1): Xaa at position 1 is His, Thr or Ser
  MOD_RES (5)..(5): Xaa at position 5 is Thr or Ser
  MOD_RES (6)..(6): Xaa at position 6 is Asp, Glu, homocysteic acid or cysteic acid
  MOD_RES (12)..(12): Xaa at position 12 is Tyr or  4-hydroxymethyl Phe
  MOD_RES (21)..(21): Xaa at position 21 is Tyr, Phe or  4-hydroxymethyl Phe
XLCGXXLVEALXLVCGERGFX

SEQ ID NO: 629 - protein, 29 aa, Homo sapiens
HAEGTFTSDVSSYLEGQAAKEFIAWLVKG

SEQ ID NO: 630 - protein, 28 aa, Homo sapiens
AEGTFTSDVSSYLEGQAAKEFIAWLVKG

SEQ ID NO: 631 - protein, 28 aa, Homo sapiens
AQGTFTSDVSSYLEGQAAKEFIAWLVKG

SEQ ID NO: 632 - protein, 28 aa, Homo sapiens
SQGTFTSDYSKYLDSRRAQDFVQWLMNT

SEQ ID NO: 633 - protein, 38 aa, Homo sapiens
  MOD_RES (38)..(38): AMIDATION
SQGTFTSDYSKYLDSRRAQDFVQWLMNTGPSSGAPPPS

SEQ ID NO: 634 - protein, 4 aa, Homo sapiens
  MOD_RES (1)..(1): Xaa at position 1 is desaminohistidine, desaminohomo-histidine, desaminotyrosine and desaminophenylalanine
  MOD_RES (2)..(2): Xaa at position 2 is glycine, alanine, serine, valine, D-alanine, aminoisobutyric acid, or N-methyl alanine
  MOD_RES (3)..(3): Xaa at position 3 is glutamic acid, aspartic acid, glutamine or asparagine
XXXG

SEQ ID NO: 635 - protein, 4 aa, Homo sapiens
  MOD_RES (2)..(2): Xaa at position 2 is glycine, alanine, serine, valine, D-alanine, aminoisobutyric acid or N-methyl alanine
HXQG

SEQ ID NO: 636 - protein, 4 aa, Homo sapiens
  MOD_RES (2)..(2): Xaa at position 2 is glycine, alanine, serine, valine, D-alanine, aminoisobutyric acid or N-methyl alanine
FXQG

SEQ ID NO: 637 - protein, 4 aa, Homo sapiens
  MOD_RES (1)..(1): Xaa at position 1 is histidine, hydroxy-histidine, homo-histidine, tyrosine or phenylalanine
  MOD_RES (2)..(2): Xaa at position 2 is glycine, alanine, serine, valine, D-alanine, aminoisobutyric acid or N-methyl alanine
XXQG

SEQ ID NO: 638 - protein, 4 aa, Homo sapiens
  MOD_RES (2)..(2): Xaa at position 2 is glycine, alanine, serine, valine, D-alanine, aminoisobutyric acid or N-methyl alanine
YXQG

SEQ ID NO: 639 - protein, 4 aa, Homo sapiens
HAQG

SEQ ID NO: 640 - protein, 4 aa, Homo sapiens
FAQG

SEQ ID NO: 641 - protein, 4 aa, Homo sapiens
YAQG

SEQ ID NO: 642 - protein, 4 aa, Homo sapiens
  MISC_FEATURE: Hydroxyl group replacing the native N-terminal amine
HAEG

SEQ ID NO: 643 - protein, 4 aa, Homo sapiens
HAEG

SEQ ID NO: 644 - protein, 4 aa, Homo sapiens
FAEG

SEQ ID NO: 645 - protein, 38 aa, Artificial Sequence
  Synthetic peptide
  MISC_FEATURE: Peptide B (dF,dF)
  MOD_RES (1)..(1): Xaa is alpha isobutyric acid (AIB)
  MISC_FEATURE (1)..(1): The amino terminus of the amino acid at position 1 is linked via a peptide bond to the peptide: D-Phe-D-Phe-PLA, wherein PLA is phenyl lactic acid that is bonded to D-Phe via an ester bond and is bonded to SEQ ID No: 645 via a peptide bond.
  MOD_RES (38)..(38): C-terminus alpha carboxylate replaced with amide
XEGTFTSDVSSYLEEQAAKEFIAWLVKGRPSSGAPPPS

SEQ ID NO: 646 - protein, 38 aa, Artificial Sequence; identical to SEQ ID NO: 645
  Synthetic peptide
  MISC_FEATURE: HO-Phe7,Glu22,GLP-Ces
  MOD_RES (1)..(1): Xaa is alpha isobutyric acid (AIB) bonded to phenyl lactic acid via an ester bond
  MOD_RES (38)..(38): C-terminus alpha carboxylate replaced with amide

SEQ ID NO: 647 - protein, 38 aa, Artificial Sequence; identical to SEQ ID NO: 645
  Synthetic peptide
  MISC_FEATURE: Peptide B (dF,dV)
  MOD_RES (1)..(1): Xaa is alpha isobutyric acid (AIB)
  MISC_FEATURE (1)..(1): The amino terminus of the amino acid at position 1 is linked via a peptide bond to the peptide: D-Phe-D-Val-PLA, wherein PLA is phenyl lactic acid that is bonded to D-Val via an ester bond and bonded to SEQ ID No: 647 via a peptide bond
  MOD_RES (38)..(38): C-terminus alpha carboxylate replaced with amide

SEQ ID NO: 648 - protein, 39 aa, Artificial Sequence
  Synthetic peptide
  MISC_FEATURE: Ser11, Glu22 GLP-Cex
  MOD_RES (2)..(2): Xaa is AIB
  MOD_RES (39)..(39): C-terminus alpha carboxylate replaced with amide
HXEGSFTSDVSSYLEEQAAKEFIAWLVKGRPSSGAPPPS

SEQ ID NO: 649 - protein, 39 aa, Artificial Sequence; identical to SEQ ID NO: 648
  Synthetic peptide
  MISC_FEATURE: Peptide D Ser11(dF,dV)
  MOD_RES (2)..(2): Xaa is AIB
  MOD_RES (5)..(5): Ser is linked to D-Phe-D-Val via an ester bond formed through the carboxyl group of D-Val and the hydroxyl group of Ser side chain.
  MOD_RES (39)..(39): C-terminus alpha carboxylate replaced with amide

SEQ ID NO: 650 - protein, 39 aa, Artificial Sequence
  Synthetic peptide
  MISC_FEATURE: desNH2-His7, Ser8, Glu22 GLP-Cex
  MOD_RES (1)..(1): Xaa is desamino-His
  MOD_RES (39)..(39): C-terminus alpha carboxylate replaced with amide
XSEGTFTSDVSSYLEEQAAKEFIAWLVKGRPSSGAPPPS

SEQ ID NO: 651 - protein, 39 aa, Artificial Sequence; identical to SEQ ID NO: 650
  Synthetic peptide
  MISC_FEATURE: Peptide F- Ser2(dF,dV)
  MOD_RES (1)..(1): Xaa is desamino-His
  MOD_RES (2)..(2): Ser is linked to D-Phe-D-Val via an ester bond formed through the carboxyl group of D-Val and the hydroxyl group of Ser side chain.
  MOD_RES (39)..(39): C-terminus alpha carboxylate replaced with amide

SEQ ID NO: 652 - protein, 39 aa, Artificial Sequence
  Synthetic Peptide
  MISC_FEATURE: Peptide X-Ser2(dF,dV)
  MOD_RES (2)..(2): Ser is linked to D-Phe-D-Val via an ester bond formed through the carboxyl group of D-Val and the hydroxyl group of Ser side chain
  MOD_RES (39)..(39): C-terminus alpha carboxylate replaced with amide
HSEGTFTSDVSSYLEEQAAKEFIAWLVKGRPSSGAPPPS

SEQ ID NO: 653 - protein, 39 aa, Artificial Sequence
  Synthetic Peptide
  MISC_FEATURE: Aib8, Glu22 GLP-Cex 40kPeg
  MOD_RES (2)..(2): Xaa is Aib
  MOD_RES (24)..(24): Cys is covalently attached to 40kDa PEG
  MOD_RES (39)..(39): C-terminus alpha carboxylate replaced with amide
HXEGTFTSDVSSYLEEQAAKEFICWLVKGRPSSGAPPPS

SEQ ID NO: 654 - protein, 39 aa, Artificial Sequence
  Synthetic Peptide
  MISC_FEATURE: GLP Aib8, Ser11 (dF, dV) Glu22 GLP-Cex 40kPeg
  MOD_RES (2)..(2): Xaa is Aib
  MOD_RES (5)..(5): Ser is linked to D-Phe-D-Val via ester bond formed through the carboxyl group of d-Val and the hydroxyl group of the Ser side chain
  MOD_RES (24)..(24): Cys is covalently attached to 40kDa PEG
  MOD_RES (39)..(39): C-terminus alpha carboxylate replaced with amide
HXEGSFTSDVSSYLEEQAAKEFICWLVKGRPSSGAPPPS

SEQ ID NO: 655 - protein, 39 aa, Artificial Sequence
  Synthetic Peptide
  MISC_FEATURE: GLP des-NH2His7, Ser8, Glu22-Cex 40kPeg
  MOD_RES (1)..(1): Xaa is desamino-His
  MOD_RES (24)..(24): Cys is covalently attached to a 40kDa PEG
  MOD_RES (39)..(39): C-terminus alpha carboxylate replaced with amide
XSEGTFTSDVSSYLEEQAAKEFICWLVKGRPSSGAPPPS

SEQ ID NO: 656 - protein, 39 aa, Artificial Sequence; identical to SEQ ID NO: 655
  Synthetic Peptide
  MISC_FEATURE: GLP des-NH2His7, Ser8(dFdV), Glu22-Cex 40kPeg
  MOD_RES (1)..(1): Xaa is desamino-His
  MOD_RES (2)..(2): Ser is linked to D-Phe-D-Val via an ester bond formed through the carboxyl group of d-Val and the hydroxyl group of the Ser side chain
  MOD_RES (24)..(24): Cys is covalently attached to a 40kDa PEG
  MOD_RES (39)..(39): C-terminus alpha carboxylate replaced with amide

SEQ ID NO: 657 - protein, 32 aa, Artificial Sequence
  Synthetic Peptide
  MISC_FEATURE: GHRH
YADAIFTNSYRKVLGQLSARKLLQDIMSRQQG

SEQ ID NO: 658 - protein, 28 aa, Artificial Sequence
  Synthetic Peptide
  MISC_FEATURE: VIP
HSDAVFTDNYTRLRKQMAVKKYLNSILN

SEQ ID NO: 659 - protein, 27 aa, Artificial Sequence
  Synthetic Peptide
  MISC_FEATURE: PACAP-27
HSDGIFTDSYSRYRKQMAVKKYLAAVL

SEQ ID NO: 660 - protein, 27 aa, Artificial Sequence
  Synthetic Peptide
  MISC_FEATURE: PHM
HADGVFTSDFSRLLGQLSAKKYLESLM

SEQ ID NO: 661 - protein, 27 aa, Artificial Sequence
  Synthetic Peptide
  MISC_FEATURE: Secretin
HSDGTFTSELSRLREGARLQRLLQGLV

SEQ ID NO: 662 - protein, 39 aa, Artificial Sequence
  Synthetic Peptide
  MISC_FEATURE: exendin-4
HGEGTFTSDLSKQMEEEAVRLFIEWLKNGGPSSGAPPPS

SEQ ID NO: 663 - protein, 33 aa, Artificial Sequence
  Synthetic Peptide
  MISC_FEATURE: Glucagon-like peptide-2 (GLP-2)
HADGSFSDEMNTILDNLAARDFINWLIQTKITD

SEQ ID NO: 664 - protein, 42 aa, Artificial Sequence
  Synthetic Peptide
  MISC_FEATURE: GIP
YAEGTFISDYSIAMDKIHQQDFVNWLLAQKGKKNDWKHNITQ

SEQ ID NO: 665 - protein, 37 aa, Artificial Sequence
  Synthetic Peptide
  MISC_FEATURE: Oxyntomodulin
HSQGTFTSDYSKYLDSRRAQDFVQWLMDTKRNRNNIA

SEQ ID NO: 666 - protein, 13 aa, Artificial Sequence
  Synthetic Peptide
KGKKNDWKHNITQ

SEQ ID NO: 667 - protein, 37 aa, Artificial Sequence
  Synthetic Peptide
  MISC_FEATURE: GLP-1 full legnth native sequence
HDEFERHAEGTFTSDVSSYLEGQAAKEFIAWLVKGRG

SEQ ID NO: 668-700 - skipped (33 entries)

SEQ ID NO: 701 - protein, 29 aa, Homo sapiens
HSQGTFTSDYSKYLDSRRAQDFVQWLMNT

SEQ ID NO: 702 - protein, 29 aa, Artificial Sequence
  Glucagon analogue
  MISC_FEATURE (16)..(16): Xaa is Ser, Cys, Orn, homocysteine or acetyl phenyalanine
  MISC_FEATURE (27)..(27): Xaa is Met, Leu or Nle
HSQGTFTSDYSKYLDXRRAQDFVQWLXDT

SEQ ID NO: 703 - protein, 29 aa, Artificial Sequence
  Glucagon analogue
  MISC_FEATURE (17)..(17): Xaa is Arg, Cys, Orn, homocysteine or acetyl phenyalanine
  MISC_FEATURE (27)..(27): Xaa is Met, Leu or Nle
HSQGTFTSDYSKYLDSXRAQDFVQWLXDT

SEQ ID NO: 704 - protein, 29 aa, Artificial Sequence
  Glucagon analogue
  MISC_FEATURE (21)..(21): Xaa is Asp, Cys, Orn, homocysteine or acetyl phenylalanine
  MISC_FEATURE (27)..(27): Xaa is Met, Leu or Nle
HSQGTFTSDYSKYLDSRRAQXFVQWLXDT

SEQ ID NO: 705 - protein, 29 aa, Artificial Sequence
  Glucagon analogue
  MISC_FEATURE (24)..(24): Xaa is Gln, Cys, Orn, homocysteine or acetyl phenylalanine
  MISC_FEATURE (27)..(27): Xaa is Met, Leu or Nle
HSQGTFTSDYSKYLDSRRAQDFVXWLXDT

SEQ ID NO: 706 - protein, 29 aa, Artificial Sequence
  Glucagon analogue
  MISC_FEATURE (21)..(21): Xaa is Asp, Cys, Orn, homocysteine or acetyl phenyalanine
  MISC_FEATURE (24)..(24): Xaa is Gln, Cys, Orn, homocysteine or acetyl phenyalanine
  MISC_FEATURE (27)..(27): Xaa is Met, Leu or Nle
HSQGTFTSDYSKYLDSRRAQXFVXWLXDT

SEQ ID NO: 707 - protein, 29 aa, Artificial Sequence
  Glucagon analogue
  MISC_FEATURE (27)..(27): Xaa is Met, Leu or Nle
  MISC_FEATURE (28)..(28): Xaa is Lys, Arg, His, Asp, Glu, cysteic acid or homocysteic acid
  MISC_FEATURE (29)..(29): Xaa is Thr, Lys, Arg, His, Asp, Glu, cysteic acid or homocysteic acid
HSQGTFTSDYSKYLDSRRAQDFVQWLXXX

SEQ ID NO: 708 - protein, 29 aa, Artificial Sequence
  Glucagon analogue
  MISC_FEATURE (27)..(27): Xaa is Met, Leu or Nle
  MISC_FEATURE (28)..(28): Xaa is Asp or Glu
  MISC_FEATURE (29)..(29): Xaa is Thr, Asp or Glu
HSQGTFTSDYSKYLDSRRAQDFVQWLXXX

SEQ ID NO: 709 - protein, 29 aa, Artificial Sequence
  Glucagon analogue
  MISC_FEATURE (27)..(27): Xaa is Met, Leu or Nle
  MISC_FEATURE (29)..(29): Xaa is Asp or Glu
HSQGTFTSDYSKYLDSRRAQDFVQWLXNX

SEQ ID NO: 710 - protein, 29 aa, Artificial Sequence
  Glucagon analogue
  MISC_FEATURE (27)..(27): Xaa is Met, Leu or Nle
HSQGTFTSDYSKYLDSRRAQDFVQWLXDT

SEQ ID NO: 711 - protein, 29 aa, Artificial Sequence
  Glucagon analogue
HSQGTFTSDYSKYLDSRRAQDFVQWLMDT

SEQ ID NO: 712 - protein, 29 aa, Artificial Sequence
  Glucagon analogue
  MISC_FEATURE (29)..(29): Xaa is Lys, Arg or His
HSQGTFTSDYSKYLDSRRAQDFVQWLMNX

SEQ ID NO: 713 - protein, 29 aa, Artificial Sequence
  Glucagon analogue
HSQGTFTSDYSKYLESRRAQDFVQWLMDT

SEQ ID NO: 714 - protein, 29 aa, Artificial Sequence
  Glucagon analogue
  MOD_RES (16)..(16): pegylation
  MISC_FEATURE (27)..(27): Xaa is Met, Leu or Nle
HSQGTFTSDYSKYLDCRRAQDFVQWLXDT

SEQ ID NO: 715 - protein, 29 aa, Artificial Sequence
  Glucagon analogue
  MOD_RES (17)..(17): pegylation
  MISC_FEATURE (27)..(27): Xaa is Met, Leu or Nle
HSQGTFTSDYSKYLDSCRAQDFVQWLXDT

SEQ ID NO: 716 - protein, 29 aa, Artificial Sequence
  Glucagon analogue
  MOD_RES (21)..(21): pegylation
  MISC_FEATURE (27)..(27): Xaa at position 27 = Met, Leu or Nle
HSQGTFTSDYSKYLDSRRAQCFVQWLXDT

SEQ ID NO: 717 - protein, 29 aa, Artificial Sequence
  Glucagon analogue
  MOD_RES (24)..(24): pegylation
  MISC_FEATURE (27)..(27): Xaa at position 27 = Met, Leu or Nle
HSQGTFTSDYSKYLDSRRAQDFVCWLXDT

SEQ ID NO: 718 - protein, 29 aa, Artificial Sequence
  Glucagon analogue
  MOD_RES (21)..(21): pegylation
  MISC_FEATURE (27)..(27): Xaa is Met, Leu or Nle
HSQGTFTSDYSRYLDSRRAQKFVQWLXDT

SEQ ID NO: 719 - protein, 29 aa, Artificial Sequence
  Glucagon analogue
  MOD_RES (24)..(24): pegylation
  MISC_FEATURE (27)..(27): Xaa is Met, Leu or Nle
HSQGTFTSDYSRYLDSRRAQDFVKWLXDT

SEQ ID NO: 720 - protein, 10 aa, Artificial Sequence
  peptide fragment representing the carboxy terminal 10 amino acids of Exendin-4
GPSSGAPPPS

SEQ ID NO: 721 - protein, 8 aa, Artificial Sequence
  peptide fragment representing the carboxy terminal 8 amino acids of oxyntomodulin
KRNRNNIA

SEQ ID NO: 722 - protein, 4 aa, Artificial Sequence
  peptide fragment representing the amino 4 amino acids of oxyntomodulin carboxy terminus of SEQ ID NO: 21
KRNR

SEQ ID NO: 723 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 724 - protein, 39 aa, Artificial Sequence
  Glucagon analogue
HSQGTFTSDYSKYLDSRRAQDFVQWLMDTGPSSGAPPPS

SEQ ID NO: 725 - protein, 37 aa, Artificial Sequence; identical to SEQ ID NO: 665
  Glucagon analogue

SEQ ID NO: 726 - protein, 33 aa, Artificial Sequence
  Glucagon analogue
HSQGTFTSDYSKYLDSRRAQDFVQWLMDTKRNR

SEQ ID NO: 727 - protein, 29 aa, Artificial Sequence
  Glucagon analogue
HSQGTFTSDYSKYLDSCRAQDFVQWLMNT

SEQ ID NO: 728 - protein, 39 aa, Artificial Sequence; identical to SEQ ID NO: 36
  Glucagon Analogue

SEQ ID NO: 729 - protein, 29 aa, Artificial Sequence
  Glucagon analogue
  MOD_RES (24)..(24): 2-butyrolactone bound through thiol group of cys
HSQGTFTSDYSKYLDSRRAQDFVQWLMNT

SEQ ID NO: 730 - protein, 29 aa, Artificial Sequence
  Glucagon Analogue
  MOD_RES (24)..(24): carboxymethyl group bound through thiol group of cys
HSQGTFTSDYSKYLDSRRAQDFVQWLMNT

SEQ ID NO: 731 - protein, 39 aa, Artificial Sequence; identical to SEQ ID NO: 36
  Glucagon analogue

SEQ ID NO: 732 - protein, 30 aa, Artificial Sequence
  Glucagon analogue
  MISC_FEATURE (30)..(30): Xaa is Asp, Glu, Lys, Arg or His
HSQGTFTSDYSKYLDSRRAQDFVQWLMDTX

SEQ ID NO: 733 - protein, 29 aa, Artificial Sequence
  Glucagon analogue
  MISC_FEATURE (15)..(15): Xaa is Asp, Glu, cysteic acid, homoglutamic acid or homocysteic acid
  MISC_FEATURE (27)..(27): Xaa is Met, Leu or Nle
  MISC_FEATURE (28)..(28): Xaa is Asn, Lys, Arg, His, Asp or Glu
  MISC_FEATURE (29)..(29): Xaa is Thr, Lys, Arg, His, Asp or Glu
HSQGTFTSDYSKYLXSRRAQDFVQWLXXX

SEQ ID NO: 734 - protein, 29 aa, Artificial Sequence
  Glucagon analogue
  MISC_FEATURE (15)..(15): Xaa is Asp, Glu, cysteic acid, homoglutamic acid or homocysteic acid
  MISC_FEATURE (27)..(27): Xaa is Met, Leu or Nle
  MISC_FEATURE (28)..(28): Xaa is Asn or an acidic amino acid
  MISC_FEATURE (29)..(29): Xaa is Thr or an acidic amino acid
HSQGTFTSDYSKYLXSRRAQDFVQWLXXX

SEQ ID NO: 735 - protein, 39 aa, Artificial Sequence
  Glucagon analogue
HSQGTFTSDYSKYLDSRRAQDFVQWLMETGPSSGAPPPS

SEQ ID NO: 736 - protein, 37 aa, Artificial Sequence
  Glucagon analogue
HSQGTFTSDYSKYLDSRRAQDFVQWLMETKRNRNNIA

SEQ ID NO: 737 - protein, 33 aa, Artificial Sequence
  Glucagon analogue
HSQGTFTSDYSKYLDSRRAQDFVQWLMETKRNR

SEQ ID NO: 738 - protein, 29 aa, Artificial Sequence
  Glucagon analogue
HSQGTFTSDYSKYLDSRRAQDFVQWLMET

SEQ ID NO: 739 - protein, 27 aa, Artificial Sequence
  Synthetic peptide
  MOD_RES (1)..(1): Xaa can be any amino acid
  MOD_RES (2)..(2): Xaa can be any amino acid
  MOD_RES (27)..(27): Met comprises Z
XXQGTFTSDYSKYLDSRRAQDFVQWLM

SEQ ID NO: 740 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): PEG group attached to cysteine at residue 24
XSQGTFTSDYSKYLDERRAKDFVCWLMNT

SEQ ID NO: 741 - protein, 29 aa, Artificial Sequence
  Synthetic peptide
  MOD_RES (1)..(1): Xaa us DMIA
  MISC_FEATURE (16)..(20): Lactam bridge between residues 16 and 20
  MISC_FEATURE (24)..(24): Glutamine to alanine mutation
  MOD_RES (29)..(29): PEG group attached to cysteine at residue 29
XSQGTFTSDYSKYLDERRAKDFVAWLMNC

SEQ ID NO: 742 - protein, 29 aa, Artificial Sequence
  Synthetic peptide
  MOD_RES (1)..(1): Xaa is DMIA
  MISC_FEATURE (16)..(20): Lactam bridge between residues 16 and 20
  MOD_RES (24)..(24): PEG group attached to cysteine at residue 24
  MOD_RES (27)..(27): Xaa can be either norleucine or leucine
XSQGTFTSDYSKYLDERRAKDFVCWLXNT

SEQ ID NO: 743 - protein, 29 aa, Artificial Sequence
  Synthetic peptide
  MOD_RES (1)..(1): Xaa is DMIA
  MISC_FEATURE (16)..(20): Lactam bridge between residues 16 and 20
  MOD_RES (24)..(24): Glutamine to alanine mutation
  MOD_RES (27)..(27): Xaa can be either norleucine or leucine
  MOD_RES (29)..(29): PEG group attached to cysteine at residue 29
XSQGTFTSDYSKYLDERRAKDFVAWLXNC

SEQ ID NO: 744 - protein, 29 aa, Artificial Sequence
  Synthetic peptide
  MISC_FEATURE: SEQ ID NO: 701 with A20,A24,Nle27,D28
  MOD_RES (27)..(27): Nle
HSQGTFTSDYSKYLDSRRAADFVAWLXDT

SEQ ID NO: 745 - protein, 29 aa, Artificial Sequence
  Synthetic peptide
  MISC_FEATURE: SEQ ID NO: 701 with A20,A24,Nle27,D28,E29
  MOD_RES (27)..(27): Nle
HSQGTFTSDYSKYLDSRRAADFVAWLXDE

SEQ ID NO: 746 - protein, 30 aa, Artificial Sequence
  Synthetic peptide
  MISC_FEATURE: SEQ ID NO: 701 with A20,A24,Nle27,D28,E30
  MOD_RES (27)..(27): Nle
HSQGTFTSDYSKYLDSRRAADFVAWLXDTE

SEQ ID NO: 747 - protein, 29 aa, Artificial Sequence
  Synthetic peptide
  MISC_FEATURE: SEQ ID NO: 701 with A20,A24,Nle27,E28,E29
  MOD_RES (27)..(27): Nle
HSQGTFTSDYSKYLDSRRAADFVAWLXEE

SEQ ID NO: 748 - protein, 30 aa, Artificial Sequence
  Synthetic peptide
  MISC_FEATURE: SEQ ID NO: 701 with A20,A24,Nle27,E28,E30
  MOD_RES (27)..(27): Nle
HSQGTFTSDYSKYLDSRRAADFVAWLXETE

SEQ ID NO: 749 - protein, 30 aa, Artificial Sequence
  Synthetic peptide
  MISC_FEATURE: SEQ ID NO: 701 with A20,A24,Nle27,E29,E30
  MOD_RES (27)..(27): Nle
HSQGTFTSDYSKYLDSRRAADFVAWLXNEE

SEQ ID NO: 750 - protein, 29 aa, Artificial Sequence
  Synthetic peptide
  MISC_FEATURE: SEQ ID NO: 701 with A20,E21,A24,Nle27,D28
  MOD_RES (27)..(27): Nle
HSQGTFTSDYSKYLDSRRAAEFVAWLXDT

SEQ ID NO: 751 - protein, 29 aa, Artificial Sequence
  Synthetic peptide
  MISC_FEATURE: SEQ ID NO: 701 with A20,E21,A24,Nle27,D28,E29
  MOD_RES (27)..(27): Nle
HSQGTFTSDYSKYLDSRRAAEFVAWLXDE

SEQ ID NO: 752 - protein, 29 aa, Artificial Sequence
  Synthetic peptide
  MISC_FEATURE: SEQ ID NO: 701 with A20,E21,A24,Nle27,D28,E30
  MOD_RES (27)..(27): Nle
HSQGTFTSDYSKYLDSRRAAEFVAWLXDE

SEQ ID NO: 753 - protein, 29 aa, Artificial Sequence
  Synthetic peptide
  MISC_FEATURE: SEQ ID NO :701 with A20,E21,A24,Nle27,E28,E29
  MOD_RES (27)..(27): Nle
HSQGTFTSDYSKYLDSRRAAEFVAWLXEE

SEQ ID NO: 754 - protein, 29 aa, Artificial Sequence
  Synthetic peptide
  MISC_FEATURE: SEQ ID NO: 701 with A20, E21, A24, Nle27, E28, E30
HSQGTFTSDYSKYLDSRRAQDFVQWLMNT

SEQ ID NO: 755 - protein, 30 aa, Artificial Sequence
  Synthetic peptide
  MISC_FEATURE: SEQ ID NO: 701 with A20, E21, A24, Nle27, E29, E30
  MOD_RES (27)..(27): Nle
HSQGTFTSDYSKYLDSRRAAEFVAWLXNEE

SEQ ID NO: 756 - protein, 29 aa, Artificial Sequence
  Synthetic peptide
  MISC_FEATURE: SEQ ID NO: 1 with T16, A20, E21, A24, Nle27, D28, and E29
  MOD_RES (27)..(27): Nle
HSQGTFTSDYSKYLDTRRAAEFVAWLXDE

SEQ ID NO: 757 - protein, 31 aa, Homo sapiens; identical to SEQ ID NO: 50

SEQ ID NO: 758 - protein, 30 aa, Homo sapiens; identical to SEQ ID NO: 52
  MOD_RES (30)..(30): AMIDATION

SEQ ID NO: 759-800 - skipped (42 entries)

SEQ ID NO: 801 - protein, 29 aa, Homo sapiens
  MISC_FEATURE: wild type glucagon
HSQGTFTSDYSKYLDSRRAQDFVQWLMNT

SEQ ID NO: 802 - protein, 31 aa, Homo sapiens; identical to SEQ ID NO: 50
  MISC_FEATURE (1)..(31): GLP-1(7-37)

SEQ ID NO: 803 - protein, 30 aa, Artificial sequence; identical to SEQ ID NO: 52
  Synthetic peptide
  MISC_FEATURE (1)..(30): GLP-1(7-36) amidated
  MISC_FEATURE (30)..(30): C-terminal amidation

SEQ ID NO: 804 - protein, 42 aa, Homo sapiens; identical to SEQ ID NO: 664
  mat_peptide (1)..(42): gastric inhibitory polypeptide

SEQ ID NO: 805 - protein, 29 aa, Artificial sequence
  Synthetic polypeptide Analog 61
  MISC_FEATURE (16)..(20): Lactam bridge between residues 16 and 20.
HSQGTFTSDYSKYLDEIHQKEFIAWLMNT

SEQ ID NO: 806 - protein, 29 aa, Artificial sequence
  Synthetic polypeptide Analog 62
  MISC_FEATURE (16)..(20): Lactam bridge between residues 16 and 20.
HSQGTFTSDYSIYLDEIHQKEFIAWLMNT

SEQ ID NO: 807 - protein, 29 aa, Artificial sequence
  Synthetic polypeptide Analog 63
  MISC_FEATURE (12)..(16): Lactam bridge between residues 12 and 16.
HSQGTFTSDYSKYLDEIHQKEFIAWLMNT

SEQ ID NO: 808 - protein, 29 aa, Artificial sequence
  Synthetic polypeptide Analog 66
HSQGTFTSDYSKYLDEIHQKEFIAWLLAQ

SEQ ID NO: 809 - protein, 29 aa, Artificial sequence
  Synthetic polypeptide Analog 68
HSQGTFTSDYSKYLDKIHQEEFIAWLMNT

SEQ ID NO: 810 - protein, 29 aa, Artificial sequence
  Synthetic polypeptide Analog 69
  MISC_FEATURE (16)..(20): Lactam bridge between residues 16 and 20
HSQGTFTSDYSKYLDKIHQEEFIAWLMNT

SEQ ID NO: 811 - protein, 29 aa, Artificial sequence
  Synthetic polypeptide Analog 84
  MISC_FEATURE (16)..(20): Lactam bridge between residues 16 and 20
HSQGTFTSDYSIYLDEIHQKEFICWLLAQ

SEQ ID NO: 812 - protein, 29 aa, Artificial sequence
  Synthetic polypeptide Analog 85
  MISC_FEATURE (16)..(20): Lactam bridge between residues 16 and 20
  MISC_FEATURE (24)..(24): PEG group (20k) attached to cysteine at residue 24
HSQGTFTSDYSIYLDEIHQKEFICWLLAQ

SEQ ID NO: 813 - protein, 29 aa, Artificial sequence
  Synthetic polypeptide Analog 92
HSQGTFTSDYSIYLDEKHQKEFIAWLLAQ

SEQ ID NO: 814 - protein, 29 aa, Artificial sequence
  Synthetic polypeptide Analog 93
  MISC_FEATURE (16)..(20): Lactam bridge between residues 16 and 20
  MISC_FEATURE (17)..(21): Lactam bridge between residues 17 and 21
HSQGTFTSDYSIYLDEKHQKEFIAWLLAQ

SEQ ID NO: 815 - protein, 29 aa, Artificial sequence
  Synthetic polypeptide Analog 95
  MISC_FEATURE (16)..(20): Lactam bridge between residues 16 and 20
HAEGTFISDYSIAMDEIHQKDFVNWLLAQ

SEQ ID NO: 816 - protein, 29 aa, Artificial sequence
  Synthetic polypeptide Analog 96
  MISC_FEATURE (16)..(20): Lactam bridge between residues 16 and 20
YAEGTFISDYSIAMDEIHQKDFVNWLLAQ

SEQ ID NO: 817 - protein, 29 aa, Artificial sequence
  Synthetic polypeptide Analog 97
  MISC_FEATURE (16)..(20): Lactam bridge between residues 16 and 20
HAEGTFTSDYSIYMDEIHQKDFVNWLLAQ

SEQ ID NO: 818 - protein, 29 aa, Artificial sequence
  Synthetic polypeptide Analog 98
  MISC_FEATURE (16)..(20): Lactam bridge between residues 16 and 20
YAEGTFTSDYSIYMDEIHQKDFVNWLLAQ

SEQ ID NO: 819 - protein, 42 aa, Artificial sequence
  Synthetic polypeptide Analog 99
YAEGTFISDYSIAMDKIHQQDFVNWLLAQKGKKNWLKHNITQ

SEQ ID NO: 820 - protein, 42 aa, Artificial sequence
  Synthetic polypeptide Analog 100
  MOD_RES (2)..(2): Xaa is Aib
YXEGTFISDYSIAMDKIHQQDFVNWLLAQKGKKNWLKHNITQ

SEQ ID NO: 821 - protein, 42 aa, Artificial sequence
  Synthetic polypeptide Analog 101
YAPGTFISDYSIAMDKIHQQDFVNWLLAQKGKKNWLKHNITQ

SEQ ID NO: 822 - protein, 42 aa, Artificial sequence
  Synthetic polypeptide Analog 102
  MOD_RES (2)..(2): Xaa is Aib
YXEGTFISDYSIAMDKIHQQDFVCWLLAQKGKKNWLKHNITQ

SEQ ID NO: 823 - protein, 42 aa, Artificial sequence
  Synthetic polypeptide Analog 104
YAPGTFISDYSIAMDKIHQQDFVCWLLAQKGKKNWLKHNITQ

SEQ ID NO: 824 - protein, 42 aa, Artificial sequence; identical to SEQ ID NO: 823
  Synthetic polypeptide Analog 105
  MISC_FEATURE (24)..(24): PEG (40k) attached to cysteine and residue 24

SEQ ID NO: 825 - protein, 29 aa, Artificial sequence
  Synthetic polypeptide Analog 106
YAEGTFISDYSIAMDKIHQQDFVNWLLAQ

SEQ ID NO: 826 - protein, 29 aa, Artificial sequence
  Synthetic polypeptide Analog 107
  MISC_FEATURE (16)..(20): Lactam bridge between residues 16 and 20
HSQGTFISDYSKYLDEIHQKEFIAWLMNT

SEQ ID NO: 827 - protein, 29 aa, Artificial sequence
  Synthetic polypeptide Analog 108
  MISC_FEATURE (16)..(20): Lactam bridge between residues 16 and 20
HSQGTFISDYSKALDEIHQKEFIAWLMNT

SEQ ID NO: 828 - protein, 29 aa, Artificial sequence
  Synthetic polynucleotide Analog 109
  MISC_FEATURE (16)..(20): Lactam bridge between residues 16 and 20
YSQGTFTSDYSKYLDEIHQKDFVNWLLAQ

SEQ ID NO: 829 - protein, 29 aa, Artificial sequence
  Synthetic polypeptide Analog 110
  MISC_FEATURE (16)..(20): Lactam bridge between residues 16 and 20
YSQGTFTSDYSIYLDEIHQKDFVNWLLAQ

SEQ ID NO: 830 - protein, 29 aa, Artificial sequence
  Synthetic polypeptide Analog 111
  MISC_FEATURE (16)..(20): Lactam bridge between residues 16 and 20
HSQGTFTSDYSKYLDEIHQKDFVNWLLAQ

SEQ ID NO: 831 - protein, 24 aa, Artificial sequence
  Synthetic polypeptide Analog 113
  MOD_RES (1)..(1): Xaa is 3-phenyllactic acid
  MISC_FEATURE (11)..(15): Lactam bridge between residues 11 and 15
XISDYSIAMDEIHQKDFVNWLLAQ

SEQ ID NO: 832 - protein, 24 aa, Artificial sequence
  Synthetic polypeptide Analog 114
  MOD_RES (1)..(1): Xaa is 3-phenyllactic acid
  MISC_FEATURE (11)..(15): Lactam bridge between residues 11 and 15
XTSDYSKYLDEIHQKDFVNWLLAQ

SEQ ID NO: 833 - protein, 39 aa, Artificial sequence
  Synthetic polypeptide Analog 115
  MISC_FEATURE (16)..(20): Lactam bridge between residues 16 and 20
HSQGTFTSDYSKYLDEIHQKDFVNWLLAGGPSSGAPPPS

SEQ ID NO: 834 - protein, 39 aa, Artificial sequence
  Synthetic polypeptide Analog 116
  MISC_FEATURE (16)..(20): Lactam bridge between residues 16 and 20
YSQGTFTSDYSKYLDEIHQKDFVNWLLAGGPSSGAPPPS

SEQ ID NO: 835 - protein, 29 aa, Artificial sequence
  Synthetic polypeptide Analog 118
  MISC_FEATURE (16)..(20): Lactam bridge between residues 16 and 20
YSQGTFTSDYSKYLDEIHQKEFVNWLLAQ

SEQ ID NO: 836 - protein, 39 aa, Artificial sequence
  Synthetic polypeptide Analog 120
  MISC_FEATURE (16)..(20): Lactam bridge between residues 16 and 20
YSQGTFTSDYSKYLDEQAAKEFIAWLMNGGPSSGAPPPS

SEQ ID NO: 837 - protein, 29 aa, Artificial sequence
  Synthetic polypeptide Analog 124
  MISC_FEATURE (16)..(20): Lactam bridge between residues 16 and 20
HSQGTFTSDYSIYMDEIHQKDFVNWLLAQ

SEQ ID NO: 838 - protein, 29 aa, Artificial sequence
  Synthetic polypeptide Analog 125
  MISC_FEATURE (16)..(20): Lactam bridge between residues 16 and 20
YSQGTFTSDYSIYMDEIHQKDFVNWLLAQ

SEQ ID NO: 839 - protein, 39 aa, Artificial sequence
  Synthetic polypeptide Analog 127
  MISC_FEATURE (16)..(20): Lactam bridge between residues 16 and 20
YSQGTFTSDYSKYLDEQAAKEFVNWLLAGGPSSGAPPPS

SEQ ID NO: 840 - protein, 39 aa, Artificial sequence
  Synthetic polypeptide Analog 128
  MISC_FEATURE (16)..(20): Lactam bridge between residues 16 and 20
HSQGTFTSDYSKYLDEIHQKDFIAWLMNGGPSSGAPPPS

SEQ ID NO: 841 - protein, 39 aa, Artificial sequence
  Synthetic polypeptide Analog 129
  MISC_FEATURE (16)..(20): Lactam bridge between residues 16 and 20
YSQGTFTSDYSKYLDEIHQKDFIAWLMNGGPSSGAPPPS

SEQ ID NO: 842 - protein, 39 aa, Artificial sequence
  Synthetic polypeptide Analog 139
  MISC_FEATURE (16)..(20): Lactam bridge between residues 16 and 20
YSQGTFTSDYSKYLDEQAAKEFIAWLLAGGPSSGAPPPS

SEQ ID NO: 843 - protein, 39 aa, Artificial sequence
  Synthetic polypeptide Analog 140
  MISC_FEATURE (16)..(20): Lactam bridge between residues 16 and 20
YSQGTFTSDYSIYLDEQAAKEFVNWLLAGGPSSGAPPPS

SEQ ID NO: 844 - protein, 39 aa, Artificial sequence
  Synthetic polypeptide Analog 141
  MISC_FEATURE (16)..(20): Lactam bridge between residuess 16 and 20
YSQGTFTSDYSKYMDEQAAKEFVNWLLAGGPSSGAPPPS

SEQ ID NO: 845 - protein, 39 aa, Artificial sequence
  Synthetic polypeptide Analog 142
  MISC_FEATURE (16)..(20): Lactam bridge between residues 16 and 20
YAEGTFTSDYSIYMDEQAAKEFVNWLLAGGPSSGAPPPS

SEQ ID NO: 846 - protein, 39 aa, Artificial sequence
  Synthetic polypeptide Analog 143
  MISC_FEATURE (16)..(20): Lactam bridge between residues 16 and 20
YSQGTFTSDYSKYLDERRAKEFVNWLLAGGPSSGAPPPS

SEQ ID NO: 847 - protein, 39 aa, Artificial sequence
  Synthetic polypeptide Analog 144
  MISC_FEATURE (16)..(20): Lactam bridge between residues 16 and 20
YAQGTFTSDYSIYMDEQAAKEFVNWLLAGGPSSGAPPPS

SEQ ID NO: 848 - protein, 39 aa, Artificial sequence
  Synthetic polypeptide Analog 145
  MISC_FEATURE (16)..(20): Lactam bridge between residues 16 and 20
YAQGTFISDYSKYLDEQAAKEFVNWLLAGGPSSGAPPPS

SEQ ID NO: 849 - protein, 39 aa, Artificial sequence; identical to SEQ ID NO: 848
  Synthetic polypeptide Analog 146
  MISC_FEATURE (16)..(20): Lactam bridge between residues 16 and 20

SEQ ID NO: 850 - protein, 39 aa, Artificial sequence
  Synthetic polypeptide Analog 147
  MISC_FEATURE (16)..(20): Lactam bridge between residues 16 and 20
YSQGTFTSDYSIYLDEQAAKEFIAWLLAGGPSSGAPPPS

SEQ ID NO: 851 - protein, 39 aa, Artificial sequence
  Synthetic polypeptide Analog 148
  MISC_FEATURE (16)..(20): Lactam bridge between residues 16 and 20
YSEGTFTSDYSIYLDEQAAKEFIAWLLAGGPSSGAPPPS

SEQ ID NO: 852 - protein, 39 aa, Artificial sequence
  Synthetic polypeptide Analog 149
  MISC_FEATURE (16)..(20): Lactam bridge between residues 16 and 20
YAEGTFTSDYSIYLDEQAAKEFVNWLLAGGPSSGAPPPS

SEQ ID NO: 853 - protein, 39 aa, Artificial sequence
  Synthetic polypeptide Analog 150
  MISC_FEATURE (16)..(20): Lactam bridge between residues 16 and 20
YSQGTFISDYSIYLDEQAAKEFVNWLLAGGPSSGAPPPS

SEQ ID NO: 854 - protein, 39 aa, Artificial sequence; identical to SEQ ID NO: 842
  Synthetic polypeptide Analog 151
  MISC_FEATURE (16)..(20): Lactam bridge between residues 16 and 20

SEQ ID NO: 855 - protein, 39 aa, Artificial sequence
  Synthetic polypeptide Analog 152
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPS

SEQ ID NO: 856 - protein, 39 aa, Artificial sequence
  Synthetic polypeptide Analog 154
  MOD_RES (1)..(1): Xaa is hippuric acid
  MISC_FEATURE (16)..(20): Lactam bridge between residues 16 and 20
XSQGTFTSDYSIYLDEQAAKEFVNWLLAGGPSSGAPPPS

SEQ ID NO: 857 - protein, 39 aa, Artificial sequence; identical to SEQ ID NO: 839
  Synthetic polypeptide Analog 155
  MISC_FEATURE (12)..(16): Lactam bridge between residues 12 and 16

SEQ ID NO: 858 - protein, 39 aa, Artificial sequence
  Synthetic polypeptide Analog 156
  MISC_FEATURE (20)..(24): Lactam bridge between residues 20 and 24
YSQGTFTSDYSIYLDEQAAKEFVEWLLAGGPSSGAPPPS

SEQ ID NO: 859 - protein, 39 aa, Artificial sequence
  Synthetic polypeptide Analog 157
  MISC_FEATURE (24)..(28): Lactam bridge between residues 24 and 28
YSQGTFTSDYSIYLDEQAAKEFVEWLLKGGPSSGAPPPS

SEQ ID NO: 860 - protein, 39 aa, Artificial sequence
  Synthetic polypeptide Analog 158
  MOD_RES (2)..(2): Xaa is Aib
  MISC_FEATURE (16)..(20): Lactam bridge between residues 16 and 20
YXQGTFTSDYSIYLDEQAAKEFVCWLLAGGPSSGAPPPS

SEQ ID NO: 861 - protein, 39 aa, Artificial sequence
  Synthetic polypeptide Analog 162
  MOD_RES (2)..(2): Xaa is Aib
  MISC_FEATURE (16)..(20): Lactam bridge between residues 16 and 20
YXQGTFTSDYSYYLDEQAVKEFVNWLIAGGPSSGAPPPS

SEQ ID NO: 862 - protein, 29 aa, Artificial sequence
  Synthetic polypeptide Analog 163
  MISC_FEATURE (16)..(20): Lactam bridge between residues 16 and 20
YSQGTFTSDYSIYLDEQAAKEFVNWLLAG

SEQ ID NO: 863 - protein, 29 aa, Artificial sequence
  Synthetic polypeptide Analog 164
  MOD_RES (2)..(2): Xaa is Aib
  MISC_FEATURE (16)..(20): Lactam bridge between residues 16 and 20
YXQGTFTSDYSIYLDEQAAKEFVNWLLAG

SEQ ID NO: 864 - protein, 40 aa, Artificial sequence
  Synthetic polypeptide Analog 165
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPSC

SEQ ID NO: 865 - protein, 40 aa, Artificial sequence; identical to SEQ ID NO: 864
  Synthetic polypeptide Analog 166
  MOD_RES (2)..(2): Xaa is d-alanine
  MISC_FEATURE (16)..(20): Lactam bridge between residues 16 and 20

SEQ ID NO: 866 - protein, 39 aa, Artificial sequence
  Synthetic polypeptide Analog 167
  MISC_FEATURE (17)..(20): Lactam bridge between residues 17 and 20
YSQGTFTSDYSIYLDEEAAKEFVNWLLAGGPSSGAPPPS

SEQ ID NO: 867 - protein, 39 aa, Artificial sequence
  Synthetic polypeptide Analog 168
  MISC_FEATURE (18)..(21): Lactam bridge between residues 18 and 21
YSQGTFTSDYSIYLDEQKAKEFVNWLLAGGPSSGAPPPS

SEQ ID NO: 868 - protein, 29 aa, Artificial sequence
  Synthetic polypeptide Analog 169
  MOD_RES (2)..(2): Xaa is Aib
  MISC_FEATURE (16)..(20): Lactam bridge between residues 16 and 20
YXQGTFTSDYSIYLDEQAAKEFVCWLLAG

SEQ ID NO: 869 - protein, 40 aa, Artificial sequence; identical to SEQ ID NO: 864
  Synthetic polypeptide Analog 170
  MOD_RES (2)..(2): Xaa is Aib
  MISC_FEATURE (16)..(20): Lactam bridge between residues 16 and 20
  MISC_FEATURE (40)..(40): PEG (40k) attached to cysteine at residue 40

SEQ ID NO: 870 - protein, 29 aa, Artificial sequence
  Synthetic polypeptide Analog 172
  MOD_RES (2)..(2): Xaa is Aib
  MISC_FEATURE (16)..(20): Lactam bridge between residues 16 and 20
  MISC_FEATURE (24)..(24): PEG (40k) attached to cysteine at residue 24
YXQGTFTSDYSIYLDEQAAKEFVCWLLAG

SEQ ID NO: 871 - protein, 40 aa, Artificial sequence
  Synthetic polypeptide Analog 174
  MOD_RES (2)..(2): Xaa is Aib
  MISC_FEATURE (16)..(20): Lactam bridge between residues 16 and 20
YXEGTFTSDYSIYLDEQAAKEFVNWLLAGGPSSGAPPPSC

SEQ ID NO: 872 - protein, 39 aa, Artificial sequence; identical to SEQ ID NO: 860
  Synthetic polypeptide Analog 175
  MOD_RES (2)..(2): Xaa is Aib
  MISC_FEATURE (16)..(20): Lactam bridge between residues 16 and 20
  MISC_FEATURE (24)..(24): PEG (40k) attached to cysteine at residue 24

SEQ ID NO: 873 - protein, 40 aa, Artificial sequence
  Synthetic polypeptide Analog 176
  MOD_RES (2)..(2): Xaa is Aib
  MISC_FEATURE (16)..(20): Lactam bridge between residues 16 and 20
YXQGTFISDYSIYLDEQAAKEFVNWLLAGGPSSGAPPPSC

SEQ ID NO: 874 - protein, 29 aa, Artificial sequence
  Synthetic polypeptide Analog 177
  MOD_RES (2)..(2): Xaa is Aib
  MISC_FEATURE (16)..(20): Lactam bridge between residues 16 and 20
YXQGTFISDYSIYLDEQAAKEFVCWLLAG

SEQ ID NO: 875 - protein, 40 aa, Artificial sequence; identical to SEQ ID NO: 871
  Synthetic polypeptide Analog 178
  MOD_RES (2)..(2): Xaa is Aib
  MISC_FEATURE (16)..(20): Lactam bridge between residues 16 and 20
  MISC_FEATURE (40)..(40): PEG (40k) attached to cysteine at residue 40

SEQ ID NO: 876 - protein, 29 aa, Artificial sequence
  Synthetic polypeptide Analog 179
  MOD_RES (2)..(2): Xaa is Aib
  MISC_FEATURE (16)..(20): Lactam bridge between residues 16 and 20
  MISC_FEATURE (24)..(24): PEG (40k) attached to cysteine at residue 24
YXQGTFISDYSIYLDEQAAKEFVCWLLAG

SEQ ID NO: 877 - protein, 40 aa, Artificial sequence; identical to SEQ ID NO: 873
  Synthetic polypeptide Analog 182
  MOD_RES (2)..(2): Xaa is Aib
  MISC_FEATURE (16)..(20): Lactam bridge between residues 16 and 20
  MISC_FEATURE (40)..(40): PEG (40k) attached to cysteine at residue 40

SEQ ID NO: 878 - protein, 29 aa, Artificial sequence
  Synthetic polypeptide Analog 186
  MOD_RES (2)..(2): Xaa is Aib
  MISC_FEATURE (16)..(20): Lactam bridge between residues 16 and 20
  MISC_FEATURE (24)..(24): PEG (40k) attached to cysteine at residue 24
YXQGTFTSDYSIYLDEQAAKEFVCWLMNG

SEQ ID NO: 879 - protein, 39 aa, Artificial sequence; identical to SEQ ID NO: 855
  Synthetic polypeptide Analog 191
  MOD_RES (2)..(2): Xaa is Aib

SEQ ID NO: 880 - protein, 34 aa, Artificial sequence
  Synthetic polypeptide Analog 192
FTSDYSIYLDEQAAKEFVNWLLAGGPSSGAPPPS

SEQ ID NO: 881 - protein, 38 aa, Artificial sequence
  Synthetic polypeptide Analog 194
  MOD_RES (1)..(1): Xaa is Aib
XQGTFTSDYSIYLDEEAVRLFVNWLLAGGPSSGAPPPS

SEQ ID NO: 882 - protein, 26 aa, Artificial sequence
  Synthetic polypeptide Analog 197
  MISC_FEATURE (13)..(17): Lactam bridge between residues 13 and 17
GTFTSDYSIYLDEQAAKEFVNWLLAG

SEQ ID NO: 883 - protein, 28 aa, Artificial sequence
  Synthetic polypeptide Analog 198
  MOD_RES (1)..(1): Xaa is Aib
  MISC_FEATURE (15)..(19): Lactam bridge between residues 15 and 19
XQGTFTSDYSIYLDEQAAKEFVNWLLAG

SEQ ID NO: 884 - protein, 40 aa, Artificial sequence
  Synthetic polypeptide Analog 199
  MOD_RES (2)..(2): Xaa is Aib
  MISC_FEATURE (16)..(20): Lactam bridge between residues 16 and 20
YXQGTFVSDYSIYLDEQAAKEFVNWLLAGGPSSGAPPPSC

SEQ ID NO: 885 - protein, 40 aa, Artificial sequence
  Synthetic polypeptide Analog 200
  MOD_RES (2)..(2): Xaa is Aib
  MISC_FEATURE (16)..(20): Lactam bridge between residues 16 and 20
  MOD_RES (27)..(27): Xaa is Nle
YXQGTFTSDYSIYLDEQAAKEFVNWLXAGGPSSGAPPPSC

SEQ ID NO: 886 - protein, 39 aa, Artificial sequence
  Synthetic polypeptide Analog 201
  MOD_RES (2)..(2): Xaa is Aib
YXQGTFTSDYSIYLDEEAVRLFVNWLLAGGPSSGAPPPS

SEQ ID NO: 887 - protein, 40 aa, Artificial sequence; identical to SEQ ID NO: 884
  Synthetic polypeptide Analog 202
  MOD_RES (2)..(2): Xaa is Aib
  MISC_FEATURE (16)..(20): Lactam bridge between residues 16 and 20
  MISC_FEATURE (40)..(40): PEG (40k) attached to cysteine at residue 40

SEQ ID NO: 888 - protein, 40 aa, Artificial sequence; identical to SEQ ID NO: 885
  Synthetic polypeptide Analog 203
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): PEG (40k) attached to cysteine at residue 40

SEQ ID NO: 889 - protein, 40 aa, Artificial sequence
  Synthetic polypeptide Analog 204
  MOD_RES (2)..(2): Xaa is Aib
  MISC_FEATURE (16)..(20): Lactam bridge between residues 16 and 20
YXEGTFTSDYSIYLDEQAAKEFVNWLLAGRPSSGAPPPSC

SEQ ID NO: 890 - protein, 40 aa, Artificial sequence; identical to SEQ ID NO: 889
  Synthetic polypeptide Analog 205
  MOD_RES (2)..(2): Xaa is Aib
  MISC_FEATURE (16)..(20): Lactam bridge between residues 16 and 20
  MISC_FEATURE (40)..(40): PEG (40k) attached to cysteine at residue 40

SEQ ID NO: 891 - protein, 43 aa, Artificial sequence
  Synthetic polypeptide Analog 206
  MOD_RES (2)..(2): Xaa is Aib
  MISC_FEATURE (16)..(20): Lactam bridge between residues 16 and 20
YXEGTFTSDYSIYLDEQAAKEFVNWLLAGKGKKNWLKHNITQC

SEQ ID NO: 892 - protein, 43 aa, Artificial sequence
  Synthetic polypeptide Analog 207
  MOD_RES (2)..(2): Xaa is Aib
  MISC_FEATURE (16)..(20): Lactam bridge between residues 16 and 20
YXQGTFTSDYSIYLDEQAAKEFVNWLLAGKGKKNWLKHNITQC

SEQ ID NO: 893 - protein, 43 aa, Artificial sequence; identical to SEQ ID NO: 891
  Synthetic polypeptide Analog 208
  MOD_RES (2)..(2): Xaa is Aib
  MISC_FEATURE (16)..(20): Lactam bridge between residues 16 and 20
  MISC_FEATURE (43)..(43): PEG (40k) attached to cysteine at residue 43

SEQ ID NO: 894 - protein, 40 aa, Artificial sequence
  Synthetic polypeptide Analog 209
  MOD_RES (2)..(2): Xaa is Aib
  MISC_FEATURE (9)..(12): Lactam bridge between residues 9 and 12
  MISC_FEATURE (16)..(20): Lactam bridge between residues 16 and 20
YXQGTFTSEYSKYLDEQAAKEFVNWLLAGGPSSGAPPPSC

SEQ ID NO: 895 - protein, 10 aa, Artificial sequence
  Synthetic polypeptide CEX
GPSSGAPPPS

SEQ ID NO: 896 - protein, 11 aa, Artificial sequence
  Synthetic peptide
  MISC_FEATURE (1)..(1): Xaa is any amino acid
XGPSSGAPPPS

SEQ ID NO: 897 - protein, 8 aa, Artificial sequence
  Synthetic peptide
KRNRNNIA

SEQ ID NO: 898 - protein, 4 aa, Artificial sequence
  Synthetic peptide
KRNR

SEQ ID NO: 899-900 - skipped (2 entries)

SEQ ID NO: 901 - protein, 29 aa, Homo sapiens
HSQGTFTSDYSKYLDSRRAQDFVQWLMNT

SEQ ID NO: 902 - protein, 28 aa, Artificial Sequence
  Synthetic Polypeptide
  MISC_FEATURE: Glucagon analogue
  MISC_FEATURE (8)..(8): Xaa is aspartic acid, glutamic acid, cysteic acid or homocysteic acid
SQGTFTSXYSKYLDSRRAQDFVQWLMNT

SEQ ID NO: 903 - protein, 27 aa, Artificial Sequence
  Synthetic Polypeptide
  MISC_FEATURE: Glucagon analogue
  MISC_FEATURE (7)..(7): Xaa is aspartic acid, glutamic acid, cysteic acid or homocysteic acid
QGTFTSXYSKYLDSRRAQDFVQWLMNT

SEQ ID NO: 904 - protein, 26 aa, Artificial Sequence
  Synthetic Polypeptide
  MISC_FEATURE: Glucagon analogue
  MISC_FEATURE (6)..(6): Xaa is aspartic acid, glutamic acid, cysteic acid or homocysteic acid
GTFTSXYSKYLDSRRAQDFVQWLMNT

SEQ ID NO: 905 - protein, 25 aa, Artificial Sequence
  Synthetic Polypeptide
  MISC_FEATURE: Glucagon analogue
  MISC_FEATURE (5)..(5): Xaa is aspartic acid, glutamic acid, cysteic acid or homocysteic acid
TFTSXYSKYLDSRRAQDFVQWLMNT

SEQ ID NO: 906 - protein, 24 aa, Artificial Sequence
  Synthetic Polypeptide
  MISC_FEATURE: Glucagon analogue
  MISC_FEATURE (4)..(4): Xaa is glutamic acid, cysteic acid or homocysteic acid
  MISC_FEATURE (22)..(22): Xaa at position 22 is Met, Leu or Nle
FTSXYSKYLDSRRAQDFVQWLXNT

SEQ ID NO: 907 - protein, 24 aa, Artificial Sequence
  Synthetic Polypeptide
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNT

SEQ ID NO: 908 - protein, 24 aa, Artificial Sequence
  Synthetic Polypeptide
  MOD_RES (1)..(1): N-terminal amino group replaced with hydroxy group
  MISC_FEATURE (22)..(22): Xaa is  Met, Leu or Nle
  MOD_RES (24)..(24): C-terminal alpha carboxylate replaced with amide
FTSDYSRYLDSRRAQDFVQWLXNT

SEQ ID NO: 909 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenyalanine
  MISC_FEATURE (22)..(22): Xaa is Met, Leu or Nle
FTSXYSXYLDXRRAQDFVQWLXNT

SEQ ID NO: 910 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNT

SEQ ID NO: 911 - protein, 24 aa, Artificial Sequence
  Synthetic Polypetide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDSRRAQDFVXWLXNT

SEQ ID NO: 912 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenylalanine
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDXRRAQDFVXWLXNT

SEQ ID NO: 913 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVQWLXNT

SEQ ID NO: 914 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSKYLDSRRAQDFVCWLXNT

SEQ ID NO: 915 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): Pegylated
FTSXYSKYLDSRRAQDFVQWLXNC

SEQ ID NO: 916 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSRYLDSRRAQDFVKWLXNT

SEQ ID NO: 917 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVCWLXNT

SEQ ID NO: 918 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): C-terminal alpha carboxylate replaced with amide
FTSXYSKYLECRRAQDFVQWLXNT

SEQ ID NO: 919 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 920 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 921 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 922 - protein, 24 aa, Artificial Sequence
  Synthetic Polypeptide
  MISC_FEATURE: Glucagon analogue
  MISC_FEATURE (7)..(7): Xaa is Lys or Arg
  MISC_FEATURE (11)..(11): Xaa is Lys, Cys, Orn, homocycstein or acetyl phenyalanine
  MISC_FEATURE (19)..(19): Xaa is Lys, Cys, Orn, homocycstein or acetyl phenyalanine
FTSRYSXYLDXRRAQDFVXWLMNT

SEQ ID NO: 923 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNTGPSSGAPPPS

SEQ ID NO: 924 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNRNNIA

SEQ ID NO: 925 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTGPSSGAPPPS

SEQ ID NO: 926 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylation
  MISC_FEATURE (22)..(22): Xaa is Met, Leu or Nle
FTSXYSXYLDSRRAQXFVQWLXNTKRNRNNIA

SEQ ID NO: 927 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylated
  MISC_FEATURE (22)..(22): Xaa is Met, Leu or Nle
FTSXYSXYLDSRRAQXFVQWLXNTKRNR

SEQ ID NO: 928 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNR

SEQ ID NO: 929 - protein, 34 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTGPSSGAPPPS

SEQ ID NO: 930 - protein, 32 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTKRNRNNIA

SEQ ID NO: 931 - protein, 28 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQCFVQWLXNTKRNR

SEQ ID NO: 932 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 933 - protein, 39 aa, Artificial Sequence; identical to SEQ ID NO: 36
  Synthetic Polypeptide
  MISC_FEATURE: Glucagon analogue

SEQ ID NO: 934 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 935 - protein, 29 aa, Artificial Sequence
  Synthetic Polypeptide
  MISC_FEATURE: Glucagon Analogue
  MOD_RES (24)..(24): Carboxymethyl group bound through thiol group of Cysteine
HSQGTFTSDYSKYLDSRRAQCFVQWLMNT

SEQ ID NO: 936 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLESRRAQDFVQWLXNT

SEQ ID NO: 937 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLDSRRAQDFVQWLXNT

SEQ ID NO: 938 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLESRRAQDFVQWLXNT

SEQ ID NO: 939 - protein, 24 aa, Artificial Sequence
  Synthetic Polypeptide
  MISC_FEATURE: Glucagon analogue
  MISC_FEATURE (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MISC_FEATURE (23)..(23): Xaa is Asn, Asp, Glu, cysteic acid or homocysteic acid
  MISC_FEATURE (24)..(24): Xaa id Thr, Asp, Glu, cysteic acid or homocysteic acid
FTSXYSKYLDSRRAQDFVQWLXXX

SEQ ID NO: 940 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 941 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn, Asp or Glu
  MISC_FEATURE (24)..(24): Xaa is Thr, glu or Asp
FTSXYSKYLXSRRAQDFVQWLXXX

SEQ ID NO: 942 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 943 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (11)..(11): 20kDa PEG group attached to Xaa at position 11
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXCRRAQDFVQWLXXX

SEQ ID NO: 944 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (16)..(16): 20kDa PEG group attached to Xaa at position 16
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQCFVQWLXXX

SEQ ID NO: 945 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (19)..(19): Pegylated
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVCWLXXX

SEQ ID NO: 946 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (25)..(25): Xaa is Lys, Cys, Orn, homocycstein or acetyl phenyalanine
  MOD_RES (25)..(25): Pegylated
FTSXYSKYLXSRRAQDFVQWLXXXXGPSSGAPPPS

SEQ ID NO: 947 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (35)..(35): Xaa is Lys, Cys, Orn, homocysteine or acetyl phenyalanine
  MOD_RES (35)..(35): Pegylated
FTSXYSKYLXSRRAQDFVQWLXXXGPSSGAPPPSX

SEQ ID NO: 948 - protein, 39 aa, Artificial Sequence; identical to SEQ ID NO: 39
  Synthetic Polypeptide
  MISC_FEATURE: Glucagon analogue

SEQ ID NO: 949 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (22)..(22): Xaa is Met , Leu or Nle
  MISC_FEATURE (35)..(35): Xaa is Lys, Cys, Orn, homocysteine or acetyl phenyalanine
  MOD_RES (35)..(35): Pegylated
FTSXYSXYLDSRRAQDFVQWLXNTGPSSGAPPPSX

SEQ ID NO: 950 - protein, 24 aa, Artificial Sequence
  Synthetic Polypeptide
  MISC_FEATURE: Glucagon analogue
  MOD_RES (1)..(1): N-terminal amino group replaced with hydroxy group
FTSEYSKYLDSRRAQDFVQWLMNT

SEQ ID NO: 951 - protein, 20 aa, Artificial Sequence
  Synthetic Polypeptide
  MISC_FEATURE: Glucagon analogue
YSKYLDSRRAQDFVQWLMNT

SEQ ID NO: 952 - protein, 24 aa, Artificial Sequence
  Synthetic Polypeptide
  MISC_FEATURE: Glucagon analogue
  MISC_FEATURE (4)..(4): Xaa is Homocysteic acid
FTSXYSKYLDSRRAQDFVQWLMNT

SEQ ID NO: 953 - protein, 11 aa, Artificial Sequence
  Synthetic Polypeptide
  MISC_FEATURE: Peptide fragment representing the carboxy terminal 10 amino acids of Exendin-4
  MISC_FEATURE (11)..(11): Xaa is Lys, Cys, Orn, homocysteine or acetyl phenyalanine
GPSSGAPPPSX

SEQ ID NO: 954 - protein, 5 aa, Artificial Sequence
  Synthetic Polypeptide
  MISC_FEATURE (5)..(5): Thr at position 5 is linked to phenyl lactic acid via an ester bond.
HSQGT

SEQ ID NO: 955 - protein, 4 aa, Artificial Sequence
  Synthetic Polypeptide
  MISC_FEATURE (4)..(4): Thr at position 4 is linked to phenyl lactic acid via an ester bond.
SQGT

SEQ ID NO: 956 - protein, 3 aa, Artificial Sequence
  Synthetic Polypeptide
  MISC_FEATURE (3)..(3): Thr at position 3 is linked to phenyl lactic acid via an ester bond.
QGT

SEQ ID NO: 957 - protein, 2 aa, Artificial Sequence
  Synthetic Polypeptide
  MISC_FEATURE (2)..(2): Thr at position 2 is linked to phenyl lactic acid via an ester bond.
GT

SEQ ID NO: 958 - protein, 1 aa, Artificial Sequence
  Synthetic Polypeptide
  MISC_FEATURE (1)..(1): Thr at position 1 is linked to phenyl lactic acid via an ester bond.
T

SEQ ID NO: 959 - protein, 5 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (5)..(5): Thr at position 5 is linked to phenyl lactic acid via an ester bond.
XXXGT

SEQ ID NO: 960 - protein, 4 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (4)..(4): Thr at position 4 is linked to phenyl lactic acid via an ester bond.
XXGT

SEQ ID NO: 961 - protein, 3 aa, Artificial Sequence
  Synthetic Polypeptide
  MISC_FEATURE (1)..(1): Xaa is selected from a group consisting of Glu and Gln
  MISC_FEATURE (3)..(3): Thr at position 3 is linked to phenyl lactic acid via an ester bond.
XGT

SEQ ID NO: 962 - protein, 24 aa, Artificial Sequence
  Synthetic Polypeptide
  MISC_FEATURE: Peptide AL
  MOD_RES (1)..(1): N-terminal amino group replaced with hydroxy group
  MOD_RES (24)..(24): C-terminal alpha carboxylate optionally replaced with amide
FTSDYSKYLDSRRAQDFVQWLMDT

SEQ ID NO: 963 - protein, 28 aa, Artificial Sequence
  Synthetic Polypeptide
  MISC_FEATURE: Peptide AM
  MOD_RES (28)..(28): C-terminal alpha carboxylate optionally replaced with amide
SQGTFTSEYSKYLDSRRAQDFVQWLMNT

SEQ ID NO: 964 - protein, 23 aa, Artificial Sequence
  Synthetic Polypeptide
  MISC_FEATURE: Peptide AN
  MISC_FEATURE (1)..(1): The alpha amine of Thr at position 1 is linked via a peptide bond to SEQ ID NO: 955 via the carboxylate of Phenyl Lactic Acid (PLA)
  MOD_RES (23)..(23): C-terminal alpha carboxylate optionally replaced with amide
TSEYSKYLDSRRAQDFVQWLMNT

SEQ ID NO: 965 - protein, 23 aa, Artificial Sequence
  Synthetic Polypeptide
  MISC_FEATURE: Peptide AO
  MISC_FEATURE (1)..(1): The alpha amine of Thr at position 1 is linked via a peptide bond to SEQ ID NO: 954 via the carboxylate of Phenyl Lactic Acid (PLA) .
  MOD_RES (23)..(23): C-terminal alpha carboxylate optionally replaced with amide
TSEYSKYLDSRRAQDFVQWLMNT

SEQ ID NO: 966 - protein, 24 aa, Artificial Sequence
  Synthetic Polypeptide
  MISC_FEATURE: Peptide AQ
  MOD_RES (1)..(1): N-terminal amino group replaced with hydroxy group
  MISC_FEATURE (11)..(11): Xaa is amino isobutyric acid
FTSDYSKYLDXRRAQDFVQWLMNT

SEQ ID NO: 967 - protein, 24 aa, Artificial Sequence
  Synthetic Polypeptide
  MISC_FEATURE: Peptide AT
  MOD_RES (1)..(1): N-terminal amino group replaced with hydroxy group
FTSDYSKYLDERRAQDFVQWLMNT

SEQ ID NO: 968 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
XXXTGF

SEQ ID NO: 969 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
XXTGF

SEQ ID NO: 970 - protein, 4 aa, Artificial Sequence
  Synthetic Polypeptide
  MISC_FEATURE (1)..(1): Xaa is selected from a group consisting of Glu or Gln
XTGF

SEQ ID NO: 971 - protein, 24 aa, Artificial Sequence
  Synthetic Polypeptide
  MOD_RES (1)..(1): N-terminal amino group replaced with hydroxy group
  MISC_FEATURE (24)..(24): C-terminal alpha carboxylate optionally replaced with an amide
FTSEYSKYLDSRRAQDFVQWLMNT

SEQ ID NO: 972-1000 - skipped (29 entries)

SEQ ID NO: 1001 - protein, 29 aa, Homo sapiens
HSQGTFTSDYSKYLDSRRAQDFVQWLMNT

SEQ ID NO: 1002 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMNT

SEQ ID NO: 1003 - protein, 31 aa, Homo sapiens; identical to SEQ ID NO: 50

SEQ ID NO: 1004 - protein, 30 aa, Homo sapiens; identical to SEQ ID NO: 52

SEQ ID NO: 1005 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDERRAQDFVQWLMNT

SEQ ID NO: 1006 - protein, 24 aa, Artificial Sequence
  Synthetic Polypeptide
  MOD_RES (1)..(1): N-terminal amino group replaced with hydroxy group
FTSDYSKYLDERRAKDFVQWLMNT

SEQ ID NO: 1007 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAKDFVEWLMNT

SEQ ID NO: 1008 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAQDFVEWLMKT

SEQ ID NO: 1009 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(7): Xaa at position 7 is Lys or Glu
  MISC_FEATURE (10)..(10): Xaa is Asp, Glu, homoglutamic acid, cysteic acid or homocysteic acid
  MISC_FEATURE (11)..(11): Xaa is Ala, Ser, Glu, Lys, homoglutamic acid or homocysteic acid
  MISC_FEATURE (15)..(15): Xaa is Gln, Glu or Lys
  MISC_FEATURE (19)..(19): Xaa is Ala, Gln, Lys or Glu
  MISC_FEATURE (23)..(23): Xaa is Asn, Lys or an acidic amino acid
  MISC_FEATURE (24)..(24): Xaa is Thr or an acidic amino acid
FTSDYSXYLXXRRAXDFVXWLMXX

SEQ ID NO: 1010 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
  MISC_FEATURE (19)..(19): Xaa is Ala, Gln or Glu
  MISC_FEATURE (23)..(23): Xaa is Asn, Lys or an acidic amino acid
FTSDYSKYLDXRRAXDFVXWLMXT

SEQ ID NO: 1011 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
FTSDYSKYLDXRRAXDFVQWLMNT

SEQ ID NO: 1012 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (15)..(15): Xaa is Lys or Gln
  MISC_FEATURE (16)..(16): Xaa is Lys, Cys, Orn, homocysteine or acetyl phenyalanine
  MOD_RES (16)..(16): Pegylated
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDERRAXXFVXWLXNT

SEQ ID NO: 1013 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (16)..(16): Xaa is Cys, Orn, homocysteine or acetyl phenyalanine
  MOD_RES (16)..(16): Pegylated
  MISC_FEATURE (22)..(22): Xaa is Met, Leu or Nle
FTSXYSKYLDERRAXXFVQWLXNT

SEQ ID NO: 1014 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (19)..(19): Xaa is Cys, Orn, homocysteine or acetyl phenylalanine
  MOD_RES (19)..(19): Pegylated
  MISC_FEATURE (22)..(22): Xaa is Met, Leu or Nle
FTSXYSKYLDERRAXDFVXWLXNT

SEQ ID NO: 1015 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr or an acidic amino acid
FTSXYSXYLXXRRAXDFVXWLXXX

SEQ ID NO: 1016 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAQDFVQWLXXT

SEQ ID NO: 1017 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAKDFVQWLXXT

SEQ ID NO: 1018 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (15)..(19): Lactam bridge connecting residues 15 and 19
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXXRRAKDFVEWLXXT

SEQ ID NO: 1019 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (19)..(23): Lactam bridge connecting residues 19 and 23
  MISC_FEATURE (22)..(22): Xaa is Met, Leu or Nle
  MISC_FEATURE (24)..(24): Xaa is Thr or Glu
  MOD_RES (24)..(24): C-terminal alpha carboxylate replaced with amide
FTSDYSKYLXXRRAQDFVEWLXKX

SEQ ID NO: 1020 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteine
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys, Asp, Glu, cysteic acid or homocysteic acid
  MISC_FEATURE (24)..(24): Xaa is Thr, Asp, Glu, cysteic acid and homocysteic acid
FTSXYSXYLXXRRAXDFVXWLXXX

SEQ ID NO: 1021 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1022 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid and homocysteic acid
  MISC_FEATURE (22)..(22): Xaa is Met, Leu or Nle
FTSXYSKYLXERRAQDFVQWLXNT

SEQ ID NO: 1023 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (11)..(15): Lactam bridge connecting residues 11 and 15
  MISC_FEATURE (22)..(22): Xaa is Met, Leu or Nle
FTSXYSKYLXERRAKDFVQWLXNT

SEQ ID NO: 1024 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (15)..(19): Lactam bridge connecting residues 15 and 19
  MISC_FEATURE (22)..(22): Xaa is Met, Leu or Nle
FTSXYSKYLXERRAKDFVEWLXNT

SEQ ID NO: 1025 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (19)..(24): Lactam bridge connecting residues 19 and 24
  MISC_FEATURE (22)..(22): Xaa is Met, Leu or Nle
FTSXYSKYLXERRAQDFVEWLXKT

SEQ ID NO: 1026 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1027 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1028 - protein, 34 aa, Artificial Sequence
  Synthetic Polypeptide
  MISC_FEATURE: Glucagon analogue
FTSEYSKYLDERRAQDFVQWLMNTGPSSGAPPPS

SEQ ID NO: 1029 - protein, 34 aa, Artificial Sequence; identical to SEQ ID NO: 1028
  Synthetic Polypeptide
  MISC_FEATURE (7)..(11): Lactam bridge connecting residues 7 and 11

SEQ ID NO: 1030 - protein, 34 aa, Artificial Sequence
  Synthetic Polypeptide
  MISC_FEATURE: Glucagon analogue
  MISC_FEATURE (11)..(15): Lactam bridge connecting residues 11 and 15
FTSEYSKYLDERRAKDFVQWLMNTGPSSGAPPPS

SEQ ID NO: 1031 - protein, 34 aa, Artificial Sequence
  Synthetic Polypeptide
  MISC_FEATURE: Glucagon analogue
  MISC_FEATURE (7)..(11): Lactam bridge connecting residues 7 and 11
FTSDYSKYLDERRAQDFVQWLMNTGPSSGAPPPS

SEQ ID NO: 1032 - protein, 34 aa, Artificial Sequence; identical to SEQ ID NO: 1028
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11

SEQ ID NO: 1033 - protein, 34 aa, Artificial Sequence; identical to SEQ ID NO: 1030
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15

SEQ ID NO: 1034 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMDT

SEQ ID NO: 1035 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
FTSEYSKYLDERRAQDFVQWLMNT

SEQ ID NO: 1036 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15
FTSEYSKYLDERRAKDFVQWLMNT

SEQ ID NO: 1037 - protein, 31 aa, Artificial Sequence
  Synthetic Polypeptide
  MISC_FEATURE: Glucagon analogue
HSQGTFTSDYARYLDARRAREFIKWLVRGRG

SEQ ID NO: 1038 - protein, 24 aa, Artificial Sequence
  Synthetic Polypeptide
  MISC_FEATURE: Glucagon analogue
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1039 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MOD_RES (24)..(24): C-terminal alpha carboxylate replaced with amide
FTSXYSKYLXERRAKDFVQWLXNT

SEQ ID NO: 1040 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1041 - protein, 39 aa, Artificial Sequence; identical to SEQ ID NO: 36
  Synthetic Polypeptide
  MISC_FEATURE: Glucagon Analogue

SEQ ID NO: 1042 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1043 - protein, 29 aa, Artificial Sequence
  Synthetic Polypeptide
  MISC_FEATURE: Glucagon Analogue
  MOD_RES (21)..(21): Carboxymethyl group bound through thiol group of Cysteine
HSQGTFTSDYSKYLDSRRAQCFVQWLMNT

SEQ ID NO: 1044 - protein, 39 aa, Homo sapiens
HSQGTFTSDYSRYLDSRRAQDFVQWLRNTGPSSGAPPPS

SEQ ID NO: 1045 - protein, 35 aa, Artificial Sequence; identical to SEQ ID NO: 946
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (25)..(25): Xaa is Cys, Orn, homocysteine or acetyl phenyalanine
  MOD_RES (25)..(25): Pegylated

SEQ ID NO: 1046 - protein, 35 aa, Artificial Sequence; identical to SEQ ID NO: 947
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (35)..(35): Xaa is Cys, Orn, homocysteine or acetyl phenyalanine
  MOD_RES (35)..(35): Pegylated

SEQ ID NO: 1047 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid, cysteic acid or homocysteic acid
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
FTSXYSKYLXERRAQDFVQWLXXT

SEQ ID NO: 1048 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid,  cysteic acid or homocysteic acid
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
FTSXYSKYLXERRAKDFVQWLXXT

SEQ ID NO: 1049 - protein, 23 aa, Artificial Sequence
  Synthetic Polypeptide
  MISC_FEATURE: Glucagon analogue
TSDYSKYLDERRAKDFVQWLMDT

SEQ ID NO: 1050 - protein, 11 aa, Artificial Sequence
  Synthetic Polypeptide
  MISC_FEATURE: Peptide fragment representing the carboxy terminal 10 amino acids of Exendin-4 plus one additional amino acid
  MISC_FEATURE (11)..(11): Xaa is selected form the group consisting of Cys, Orn, Lys, homocysteine and acetyl phenyalanine
GPSSGAPPPSX

SEQ ID NO: 1051 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr, Gly or an acidic amino acid
FTSXYSXYLXXRRAXDFVXWLXXX

SEQ ID NO: 1052 - protein, 5 aa, Artificial Sequence
  Synthetic Polypeptide
  MISC_FEATURE (5)..(5): Thr at position 5 is linked to phenyl lactic acid via an ester bond
HSQGT

SEQ ID NO: 1053 - protein, 4 aa, Artificial Sequence
  Synthetic Polypeptide
  MISC_FEATURE (4)..(4): Thr at position 4 is linked to phenyl lactic acid via an ester bond
SQGT

SEQ ID NO: 1054 - protein, 3 aa, Artificial Sequence
  Synthetic Polypeptide
  MISC_FEATURE (3)..(3): Thr at position 3 is linked to phenyl lactic acid via an ester bond
QGT

SEQ ID NO: 1055 - protein, 2 aa, Artificial Sequence
  Synthetic Polypeptide
  MISC_FEATURE (2)..(2): Thr at position 2 is linked to phenyl lactic acid via an ester bond
GT

SEQ ID NO: 1056 - protein, 1 aa, Artificial Sequence
  Synthetic Polypeptide
  MISC_FEATURE (1)..(1): Thr at position 1 is linked to phenyl lactic acid via an ester bond
T

SEQ ID NO: 1057 - protein, 5 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (5)..(5): Thr at position 5 is linked to phenyl lactic acid via an ester bond
XXXGT

SEQ ID NO: 1058 - protein, 4 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (4)..(4): Thr at position 4 is linked to phenyl lactic acid via an ester bond
XXGT

SEQ ID NO: 1059 - protein, 3 aa, Artificial Sequence
  Synthetic Polypeptide
  MISC_FEATURE (1)..(1): Xaa is selected from a group consisting of Glu or Gln
  MISC_FEATURE (3)..(3): Thr at position 3 is linked to phenyl lactic acid via an ester bond
XGT

SEQ ID NO: 1060 - protein, 24 aa, Artificial Sequence
  Synthetic Polypeptide
  MISC_FEATURE: Peptide A
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1061 - protein, 24 aa, Artificial Sequence
  Synthetic Polypeptide
  MISC_FEATURE: Peptide B
  MOD_RES (1)..(1): N-terminal amino group replaced with hydroxy group
  MOD_RES (24)..(24): C-terminal alpha carboxylate replaced with amide
FTSEYSKYLDSRRAQDFVQWLMNT

SEQ ID NO: 1062 - protein, 24 aa, Artificial Sequence
  Synthetic Polypeptide
  MISC_FEATURE: Peptide C
  MOD_RES (1)..(1): N-terminal amino group replaced with hydroxy group
  MISC_FEATURE (4)..(7): Lactam bridge connecting residues 4 and 7
  MOD_RES (24)..(24): C-terminal alpha carboxylate replaced with amide
FTSEYSKYLDSRRAQDFVQWLMNT

SEQ ID NO: 1063 - protein, 28 aa, Artificial Sequence
  Synthetic Polypeptide
  MISC_FEATURE: Peptide D
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1064 - protein, 23 aa, Artificial Sequence
  Synthetic Polypeptide
  MISC_FEATURE: Peptide E
  MISC_FEATURE (1)..(1): The amino terminus of Thr at position 1 is linked via a peptide bond to the peptide: Ala-Glu-Gly-Thr-PLA, wherein PLA is phenyl lactic acid that is bonded to Thr via an ester bond and bonded to SEQ ID No: 1064 via a peptide bond
  MISC_FEATURE (10)..(14): Lactam bridge connecting residues 10 and 14
  MOD_RES (23)..(23): C-terminal alpha carboxylate replaced with amide
TSDYSKYLDERRAKDFVQWLMDT

SEQ ID NO: 1065 - protein, 28 aa, Artificial Sequence
  Synthetic Polypeptide
  MISC_FEATURE: Peptide F
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1066 - protein, 23 aa, Artificial Sequence
  Synthetic Polypeptide
  MISC_FEATURE: Peptide G
  MISC_FEATURE (1)..(1): The amino terminus of Thr at position 1 is linked via a peptide bond to the peptide: Ser-Gln-Gly-Thr-PLA, wherein PLA is phenyl lactic acid that is bonded to Thr via an ester bond and bonded to SEQ ID No: 1066 via a peptide bond.
  MISC_FEATURE (10)..(14): Lactam bridge connecting residues 15 and 19
  MOD_RES (23)..(23): C-terminal alpha carboxylate replaced with amide
TSDYSKYLDERRAKDFVQWLMDT

SEQ ID NO: 1067 - protein, 24 aa, Artificial Sequence
  Synthetic Polypeptide
  MISC_FEATURE: Peptide H
  MOD_RES (1)..(1): N-terminal amino group replaced with hydroxy group
  MISC_FEATURE (5)..(5): Covalently linked to a cholesterol acid moiety
  MISC_FEATURE (11)..(15): Lactam bridge connecting residues 11 to 15
  MOD_RES (24)..(24): C-terminal alpha carboxylate replaced with amide
FTSDKSKYLDERRAKDFVQWLMDT

SEQ ID NO: 1068 - protein, 25 aa, Artificial Sequence
  Synthetic Polypeptide
  MISC_FEATURE: Peptide I
  MOD_RES (1)..(1): N-terminal amino group replaced with hydroxy group
  MISC_FEATURE (11)..(15): Lactam bridge connecting residues 11 and 15
  MISC_FEATURE (25)..(25): Covalently linked to a cholesterol acid moiety
  MOD_RES (25)..(25): C-terminal alpha carboxylate replaced with amide
FTSDYSKYLDERRAKDFVQWLMDTK

SEQ ID NO: 1069 - protein, 35 aa, Artificial Sequence
  Synthetic Polypeptide
  MISC_FEATURE: Peptide J
  MOD_RES (1)..(1): N-terminal amino group replaced with hydroxy group
  MISC_FEATURE (11)..(15): Lactam bridge connectiong residues 11 and 15
  MISC_FEATURE (35)..(35): Covalently linked to a cholesterol acid moiety
  MOD_RES (35)..(35): C-terminal alpha carboxylate replaced with amide
FTSDYSKYLDERRAKDFVQWLMDTGPSSGAPPPSK

SEQ ID NO: 1070 - protein, 23 aa, Artificial Sequence
  Synthetic Polypeptide
  MISC_FEATURE: Peptide K
  MISC_FEATURE (1)..(1): The amino terminus of Thr at position 1 is linked via a peptide bond to the peptide: AIB-Gln-Gly-Thr-PLA, wherein AIB is amino isobutyric acid and PLA is phenyl lactic acid that is bonded to Thr via an ester bond and bonded to SEQ ID No: 1070 via a peptide bond.
  MISC_FEATURE (10)..(14): Lactam bridge connectiong residues 10 and 14
  MOD_RES (23)..(23): C-terminal alpha carboxylate replaced with amide
TSDYSKYLDERRAKDFVQWLMDT

SEQ ID NO: 1071 - protein, 34 aa, Artificial Sequence; identical to SEQ ID NO: 1028
  Synthetic Polypeptide
  MISC_FEATURE: Peptide L
  MOD_RES (34)..(34): C-terminal alpha carboxylate replaced with amide

SEQ ID NO: 1072 - protein, 34 aa, Artificial Sequence; identical to SEQ ID NO: 1028
  Synthetic Polypeptide
  MISC_FEATURE: Peptide M
  MOD_RES (1)..(1): N-terminal amino group replaced with hydroxy group
  MOD_RES (34)..(34): C-terminal alpha carboxylate replaced with amide

SEQ ID NO: 1073 - protein, 34 aa, Artificial Sequence; identical to SEQ ID NO: 1030
  Synthetic Polypeptide
  MISC_FEATURE: Peptide N
  MISC_FEATURE (11)..(15): Lactam bridge connecting residues 11 and 15
  MOD_RES (34)..(34): C-terminal alpha carboxylate replaced with amide

SEQ ID NO: 1074 - protein, 34 aa, Artificial Sequence; identical to SEQ ID NO: 1030
  Synthetic Polypeptide
  MISC_FEATURE: Peptide O
  MOD_RES (1)..(1): N-terminal amino group replaced with hydroxy group
  MISC_FEATURE (11)..(15): Lactam bridge connecting residues 11 and 15
  MOD_RES (34)..(34): C-termincal alpha carboxylate replaced with amide

SEQ ID NO: 1075 - protein, 24 aa, Artificial Sequence
  Synthetic Polypeptide
  MISC_FEATURE: Peptide P
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDERRAQDFVQWLMDT

SEQ ID NO: 1076 - protein, 24 aa, Artificial Sequence
  Synthetic Polypeptide
  MISC_FEATURE: Peptide Q
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1077 - protein, 24 aa, Artificial Sequence
  Synthetic Polypeptide
  MISC_FEATURE: Peptide R
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAKDFVEWLMDT

SEQ ID NO: 1078 - protein, 24 aa, Artificial Sequence
  Synthetic Polypeptide
  MISC_FEATURE: Peptide S
  MOD_RES (1)..(1): N-terminal amino group replaced with hydroxy group
  MISC_FEATURE (19)..(23): Lactam bridge connecting residues 19 and 23
  MOD_RES (24)..(24): C-terminal alpha carboxylate replaced with amide
FTSDYSKYLDERRAQDFVEWLMKT

SEQ ID NO: 1079 - protein, 24 aa, Artificial Sequence
  Synthetic Polypeptide
  MISC_FEATURE: Peptide T
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDEQAAKDFIAWLMDT

SEQ ID NO: 1080 - protein, 24 aa, Artificial Sequence
  Synthetic Polypeptide
  MISC_FEATURE: Peptide U
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDEQAAKEFIAWLMDT

SEQ ID NO: 1081 - protein, 28 aa, Artificial Sequence
  Synthetic Polypeptide
  MISC_FEATURE: Peptide V
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1082 - protein, 28 aa, Artificial Sequence
  Synthetic Polypeptide
  MISC_FEATURE: Peptide W
  MISC_FEATURE (15)..(19): Lactam bridge connecting residues 15 and 19
  MOD_RES (28)..(28): C-terminal alpha carboxylate replaced with amide
AEGTFTSEYSKYLDEQAAKEFIAWLMDT

SEQ ID NO: 1083 - protein, 29 aa, Artificial Sequence
  Synthetic Polypeptide
  MISC_FEATURE: Peptide X
  MISC_FEATURE (16)..(20): Lactam bridge connection residues 16 and 20
  MOD_RES (29)..(29): C-terminal alpha carboxylate replaced with amide
HAEGTFTSEYSKYLDERRAKDFVQWLMDT

SEQ ID NO: 1084 - protein, 29 aa, Artificial Sequence
  Synthetic Polypeptide
  MISC_FEATURE: Peptide Y
  MISC_FEATURE (16)..(20): Lactam bridge connecting bridges 16 and 20
  MOD_RES (29)..(29): C-terminal alpha carboxylate replaced with amide
HAEGTFTSEYSKYLDEQAAKEFIAWLMDT

SEQ ID NO: 1085 - protein, 26 aa, Artificial Sequence
  Synthetic Polypeptide
  MISC_FEATURE: Peptide Z
  MISC_FEATURE (13)..(17): Lactam bridge connecting residues 13 and 17
  MOD_RES (26)..(26): C-terminal alpha carboxylate replaced with amide
GTFTSEYSKYLDERRAKDFVQWLMDT

SEQ ID NO: 1086 - protein, 23 aa, Artificial Sequence
  Synthetic Polypeptide
  MISC_FEATURE: Peptide AA
  MISC_FEATURE (1)..(1): The amino terminus of Thr at position 1 is linked via a peptide bond to the peptide: Ser-Gln-Gly-Thr-PLA, wherein PLA is phenyl lactic acid that is bonded to Thr via an ester bond and bonded to SEQ ID No: 1086 via a peptide bond.
  MISC_FEATURE (10)..(14): Lactam bridge connecting residues 10 and 14
  MOD_RES (23)..(23): C-terminal alpha carboxylate replaced with amide
TSEYSKYLDERRAKDFVQWLMDT

SEQ ID NO: 1087 - protein, 23 aa, Artificial Sequence
  Synthetic Polypeptide
  MISC_FEATURE: Peptide AB
  MISC_FEATURE (1)..(1): The amino terminus of Thr at position 1 is linked via a peptide bond to the peptide: His-Ala-Glu-Gly-Thr-PLA, wherein PLA is phenyl lactic acid that is bonded to Thr via an ester bond and bonded to SEQ ID No: 1087 via a peptide bond.
  MISC_FEATURE (10)..(15): Lactam bridge connecting residues 10 and 15
  MOD_RES (23)..(23): C-terminal alpha carboxylate replaced with amide
TSDYSKYLDERRAKDFVQWLMDT

SEQ ID NO: 1088 - protein, 24 aa, Artificial Sequence
  Synthetic Polypeptide
  MISC_FEATURE: Peptide AC
  MOD_RES (1)..(1): N-terminal amino group replaced with hydroxy group
  MISC_FEATURE (7)..(11): Lactam bridge connecting residues 7 and 11
  MOD_RES (19)..(19): Pegylated
  MOD_RES (24)..(24): C-terminal alpha carboxylate replaced with amide
FTSDYSKYLDERRAQDFVCWLMDT

SEQ ID NO: 1089 - protein, 35 aa, Artificial Sequence
  Synthetic Polypeptide
  MISC_FEATURE: Peptide AD
  MOD_RES (1)..(1): N-terminal amino group replaced with hydroxy group
  MISC_FEATURE (7)..(11): Lactam bridge connecting residues 7 and 11
  MOD_RES (35)..(35): Pegylated
  MOD_RES (35)..(35): C-terminal alpha carboxylate replaced with amide
FTSDYSKYLDERRAQDFVQWLMDTGPSSGAPPPSC

SEQ ID NO: 1090 - protein, 24 aa, Artificial Sequence
  Synthetic Polypeptide
  MISC_FEATURE: Peptide AE
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSDYSKYLDERRAKDFVCWLMDT

SEQ ID NO: 1091 - protein, 35 aa, Artificial Sequence
  Synthetic Polypeptide
  MISC_FEATURE: Peptide AF
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPSSGAPPPSC

SEQ ID NO: 1092 - protein, 24 aa, Artificial Sequence
  Synthetic Polypeptide
  MISC_FEATURE: Peptide AG
  MOD_RES (1)..(1): N-terminal amino group replaced with hydroxy group
  MOD_RES (1)..(1): Covalently attached to a C16 fatty acid
  MISC_FEATURE (11)..(15): Lactam bridge connection residues 11 and 15
  MOD_RES (24)..(24): C-terminal alpha carboxylate replaced with amide
FTSDYSKYLDERRAKDFVQWLMDT

SEQ ID NO: 1093 - protein, 24 aa, Artificial Sequence
  Synthetic Polypeptide
  MISC_FEATURE: Peptide AH
  MOD_RES (1)..(1): N-terminal amino group replaced with hydroxy group
  MOD_RES (5)..(5): Linked to a C16 fatty acid via Glu residue
  MISC_FEATURE (11)..(15): Lactam bridge connecting residues 11 and 15
  MISC_FEATURE (15)..(15): Linked to a C16 fatty acid via Glu residue
  MOD_RES (24)..(24): C-terminal alpha carboxylate replaced with amide
FTSDKSKYLDERRAKDFVQWLMDT

SEQ ID NO: 1094 - protein, 24 aa, Artificial Sequence
  Synthetic Polypeptide
  MISC_FEATURE: Peptide AI
  MOD_RES (1)..(1): N-terminal amino group replaced with hydroxy group
  MISC_FEATURE (15)..(15): Linked to C16 fatty acid via Glu residue
  MOD_RES (24)..(24): C-terminal alpha carboxylate replaced with amide
FTSDYSKYLDERRAKDFVQWLMDT

SEQ ID NO: 1095 - protein, 24 aa, Artificial Sequence
  Synthetic Polypeptide
  MISC_FEATURE: Peptide AJ
  MOD_RES (1)..(1): N-terminal amino group replaced with hydroxy group
  MISC_FEATURE (11)..(15): Lactam bridge connecting residues 11 and 15
  MISC_FEATURE (19)..(19): Linked to a C16 fatty acid via Glu residue
  MOD_RES (24)..(24): C-terminal alpha carboxylate replaced with amide
FTSDYSKYLDERRAKDFVKWLMDT

SEQ ID NO: 1096 - protein, 24 aa, Artificial Sequence
  Synthetic Polypeptide
  MISC_FEATURE: Peptide AK
  MOD_RES (1)..(1): N-terminal amino group replaced with hydroxy group
  MISC_FEATURE (11)..(15): Lactam bridge connecting residues 11 and 15
  MISC_FEATURE (24)..(24): Linked to a C16 fatty acid via Glu residue
  MOD_RES (24)..(24): C-terminal alpha carboxylate replaced with amide
FTSDYSKYLDERRAKDFVQWLMDK

SEQ ID NO: 1097 - protein, 24 aa, Artificial Sequence
  Synthetic Polypeptide
  MISC_FEATURE: Peptide AP
  MOD_RES (1)..(1): N-terminal amino group replaced with hydroxy group
  MISC_FEATURE (11)..(11): Xaa is amino isobutyric acid
  MOD_RES (24)..(24): C-terminal alpha carboxylate replaced with amide
FTSDYSKYLDXRRAQDFVQWLMNT

SEQ ID NO: 1098 - protein, 24 aa, Artificial Sequence
  Synthetic Polypeptide
  MISC_FEATURE: Peptide AR
  MOD_RES (1)..(1): N-terminal amino group replaced with hydroxy group
  MISC_FEATURE (11)..(11)
  MISC_FEATURE (15)..(15): Xaa is alpha isobutyric acid
  MOD_RES (24)..(24): C-terminal alpha carboxylate replaced with amide
FTSDKSKYLDXRRAXDFVCWLMNT

SEQ ID NO: 1099 - protein, 24 aa, Artificial Sequence
  Synthetic Polypeptide
  MISC_FEATURE: Peptide AS
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1100 - protein, 24 aa, Artificial Sequence
  Synthetic Polypeptide
  MISC_FEATURE: Peptide AU
  MOD_RES (1)..(1): N-terminal amino group replaced with hydroxy group
  MOD_RES (24)..(24): C-terminal alpha carboxylate replaced with amide
FTSDKSKYLDERRAQDFVCWLMNT

SEQ ID NO: 1101 - protein, 24 aa, Artificial Sequence
  Synthetic Polypeptide
  MISC_FEATURE: Peptide AV
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1102 - protein, 24 aa, Artificial Sequence
  Synthetic Polypeptide
  MISC_FEATURE: Peptide AW
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1103 - protein, 24 aa, Artificial Sequence
  Synthetic Polypeptide
  MISC_FEATURE: Peptide AX
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKEFVQWLMDT

SEQ ID NO: 1104 - protein, 24 aa, Artificial Sequence
  Synthetic Polypeptide
  MISC_FEATURE: Peptide AY
  MOD_RES (1)..(1): N-terminal amino group replaced with hydroxy group
  MOD_RES (24)..(24): C-terminal alpha carboxylate replaced with amide
FTSDYSKYLDEQAAKEFIAWLMNT

SEQ ID NO: 1105 - protein, 34 aa, Artificial Sequence; identical to SEQ ID NO: 1030
  Synthetic Polypeptide
  MISC_FEATURE: Peptide AZ
  MOD_RES (34)..(34): C-terminal alpha carboxylate replaced with amide

SEQ ID NO: 1106 - protein, 24 aa, Artificial Sequence
  Synthetic Polypeptide
  MISC_FEATURE: Peptide BA
  MOD_RES (1)..(1): N-terminal amino group replaced with hydroxy group
  MISC_FEATURE (5)..(5): Linked to a C16 fatty acid via Glu residue
  MISC_FEATURE (7)..(7): Linked to a C16 fatty acid via Glu residue
  MOD_RES (24)..(24): C-terminal carboxylate replaced with amide
FTSDKSKYLDERRAKDFVQWLMDT

SEQ ID NO: 1107 - protein, 6 aa, Artificial Sequence
  Synthetic Polypeptide
  MISC_FEATURE (1)..(1): Xaa1 is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, valine, glycine, N-methyl serine, and aminoisobutyric acid (AIB)
  MISC_FEATURE (3)..(3): Xaa is selected from a group consisting of Glu or Gln
XXXTGF

SEQ ID NO: 1108 - protein, 5 aa, Artificial Sequence
  Synthetic Polypeptide
  MISC_FEATURE (1)..(1): Xaa is selected from a group consisting of Ser, D-serine, D-alanine, valine, glycine, N-methyl serine, and aminoisobutyric acid (AIB)
  MISC_FEATURE (2)..(2): Xaa is selected from a group consisting of Glu or Gln
XXTGF

SEQ ID NO: 1109 - protein, 4 aa, Artificial Sequence
  Synthetic Polypeptide
  MISC_FEATURE (1)..(1): Xaa is selected from a group consisting of Glu or Gln
XTGF

SEQ ID NO: 1110 - protein, 24 aa, Artificial Sequence
  Synthetic Polypeptide
  MISC_FEATURE: Peptide AL
  MOD_RES (1)..(1): N-terminal amino group replaced with hydroxy group
  MOD_RES (24)..(24): C-terminal alpha carboxylate replaced with amide
FTSDYSKYLDSRRAQDFVQWLMDT

SEQ ID NO: 1111 - protein, 28 aa, Artificial Sequence
  Synthetic Polypeptide
  MISC_FEATURE: Peptide AM
  MOD_RES (28)..(28): C-terminal alpha carboxylate replaced with amide
SQGTFTSEYSKYLDSRRAQDFVQWLMNT

SEQ ID NO: 1112 - protein, 23 aa, Artificial Sequence
  Synthetic Polypeptide
  MISC_FEATURE: Peptide AN
  MISC_FEATURE (1)..(1): The amino terminus of Thr at position 1 is linked via a peptide bond to the peptide: Ser-Gln-Gly-Thr-PLA, wherein PLA is phenyl lactic acid that is bonded to Thr via an ester bond and bonded to SEQ ID No: 1112 via a peptide bond.
  MOD_RES (23)..(23): C-terminal alpha carboxylate replaced with amide
TSEYSKYLDSRRAQDFVQWLMNT

SEQ ID NO: 1113 - protein, 23 aa, Artificial Sequence
  Synthetic Polypeptide
  MISC_FEATURE: Peptide AO
  MISC_FEATURE (1)..(1): The amino terminus of Thr at position 1 is linked via a peptide bond to the peptide: His-Ser-Gln-Gly-Thr-PLA, wherein PLA is phenyl lactic acid that is bonded to Thr via an ester bond and bonded to SEQ ID No: 1113 via a peptide bond.
  MOD_RES (23)..(23): C-terminal alpha carboxylate replaced with amide
TSEYSKYLDSRRAQDFVQWLMNT

SEQ ID NO: 1114 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSEYSKYLDERRAKDFVCWLMNT

SEQ ID NO: 1115 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Pegylated via spacer
  MOD_RES (24)..(24): C-terminal alpha carboxylate replaced with amide
FTSDYSKYLDERRAKDFVKWLMDT

SEQ ID NO: 1116 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated via rigid spacer
  MOD_RES (24)..(24): C-terminal alpha carboxylate replaced with amide
FTSDYSKYLDERRAKDFVKWLMDT

SEQ ID NO: 1117 - protein, 35 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPGPGPGPGPC

SEQ ID NO: 1118 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate reaplaced with amide
FTSDYSKYLDERRAKDFVQWLMDGGPSSGAPPPSC

The invention claimed is:

1. A method of treating diabetes, said method comprising administering an effective amount of a pharmaceutical composition comprising an insulin polypeptide, said polypeptide comprising
 an A chain;
 a B chain; and
 a dipeptide of the formula

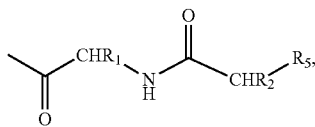

wherein said A chain comprises a sequence of $X_5IVX_6QCCX_7SICSLYQLENYCX_8$ (SEQ ID NO: 626), and said B chain comprises a sequence of $X_{13}LCGX_9X_{10}LVEALX_{11}LVCGERGFX_{12}$ (SEQ ID NO: 628), and said dipeptide is linked via an ester bond to the N-terminus, or a side chain of an amino acid located at position 1, 4 or 21 of SEQ ID NO: 626 or at the N-terminus, or a side chain of an amino acid at position 1, 5, 12 or 21 of SEQ ID NO: 628;
further wherein
 $X_5$ is HO-glycine, glycine or desamino-glycine;
 $X_6$ is glutamic acid, serine or threonine;
 $X_7$ is threonine, histidine, arginine or lysine;
 $X_8$ is asparagine, serine, threonine or glycine;
 $X_9$ is serine or threonine;
 $X_{10}$ is aspartic acid, glutamic acid, homocysteic acid or cysteic acid
 $X_{11}$ and $X_{12}$ are independently selected from the group consisting of tyrosine, phenylalanine and 4-hydroxymethyl Phe;
 $X_{13}$ is selected from the group consisting of $FVNQX_{50}$ (SEQ ID NO: 1119), $VNQX_{50}$ (SEQ ID NO: 1120), $NQX_{50}$, $QX_{50}$, and $X_{50}$, wherein $X_{50}$ is histidine, serine or threonine, further wherein the first amino acid of $X_{13}$ is an O-amino acid;
 $R_1$ and $R_2$ are independently selected from the group consisting of H, $C_1$-$C_4$ alkyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl) NHC(NH$_2^+$)NH$_2$, ($C_4$-$C_6$)cycloalkyl, ($C_0$-$C_4$ alkyl)($C_6$-$C_{10}$ aryl)$R_9$, and CH$_2$($C_5$-$C_9$ heteroaryl),
 $R_5$ is OH or NH$_2$ and $R_9$=$C_1$-$C_4$ alkyl, NH$_2$ or OH.

2. A method of treating diabetes, said method comprising administering an effective amount of a pharmaceutical composition comprising an insulin polypeptide, said polypeptide comprising
 an A chain;
 a B chain; and
 a dipeptide of the formula

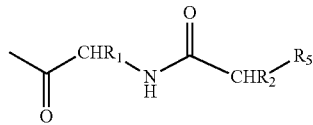

wherein said A chain comprises a sequence of $X_5IVX_6QCCX_7SICSLYQLENYCX_8$ (SEQ ID NO: 626), and said B chain comprises a sequence of $X_{13}LCGX_9X_{10}LVEALX_{11}LVCGERGFX_{12}$ (SEQ ID NO: 628), and said dipeptide is linked via an ester bond to a side chain of an amino acid located at position 4 or 21 of SEQ ID NO: 626 or at position 5 of SEQ ID NO: 628;

wherein $X_5$ is glycine, $X_7$ is selected from the group consisting of threonine, histidine, arginine and lysine, $X_{10}$ is selected from the group consisting of aspartic acid, glutamic acid, homocysteic acid and cysteic acid, $X_{11}$ and $X_{12}$ are both tyrosine and $X_6$ is glutamic acid, serine, threonine or a compound of formula XX;

$X_8$ is asparagine, serine, threonine, glycine, or a compound of formula XX;

$X_9$ is serine, threonine or a compound of formula XX; and $X_{13}$ is histidine, serine or threonine, with the proviso that one of $X_6$, $X_8$ or $X_9$ has the structure of formula XX:

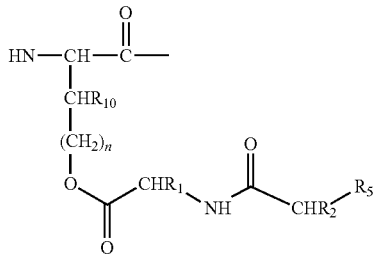
XX wherein $R_{10}$ is selected from the group consisting of H or $CH_3$, n is 0 or 3, $R_1$ is selected from the group consisting of $CH_2(CH_3)_2$, $(C_4-C_5)$cycloalkyl, $CH_2(C_6$ aryl), and $CH_2(C_5$-$C_6$ heteroaryl) and $R_2$ is selected from the group consisting of $(C_4-C_5)$cycloalkyl, $CH_2(C_6$ aryl) and $CH_2(C_5-C_6$ heteroaryl) and $R_5$ is OH or $NH_2$.

3. The method of claim 1 wherein $X_5$ is glycine, $X_6$ is glutamic acid, $X_7$ is selected from the group consisting of threonine, histidine, arginine and lysine, $X_8$ is asparagine, $X_9$ is serine, $X_{10}$ is selected from the group consisting of aspartic acid, glutamic acid, homocysteic acid and cysteic acid, and one of $X_{11}$ and $X_{12}$ is tyrosine with the other having the structure

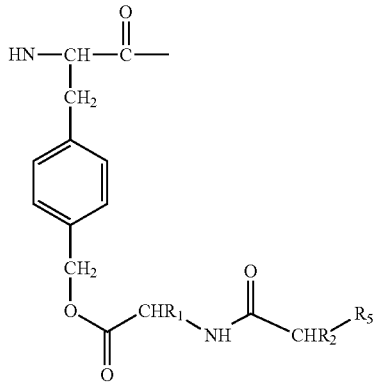

wherein $R_1$ is selected from the group consisting of $CH_2$ $(CH_3)_2$, $(C_4-C_5)$cycloalkyl, $CH_2(C_6$ aryl), and $CH_2(C_5$-$C_6$ heteroaryl) and $R_2$ is selected from the group consisting of $(C_4-C_5)$cycloalkyl, $CH_2(C_6$ aryl) and $CH_2(C_5-C_6$ heteroaryl) and $R_5$ is OH or $NH_2$.

4. The method of claim 1 further comprising a hydrophilic moiety covalently linked to the amino terminus of the B chain, or to an amino acid at position B29 of the B chain, relative to the native insulin B chain sequence.

5. The method of claim 4 wherein the hydrophilic moiety is selected from the group consisting of a plasma protein, a polyethylene glycol chain and an Fc portion of an immunoglobin.

6. The method of claim 1 wherein a depot polymer is linked to the side chain of an amino acid of the ester linked dipeptide of the formula

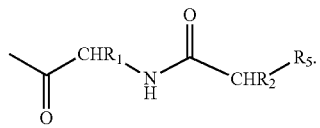

7. The method of claim 6 wherein the depot polymer is selected from the group consisting of polyethylene glycol, dextran, polylactic acid, polyglycolic acid and a copolymer of lactic acid and glycolic acid.

8. The method of claim 1
wherein
$X_5$ is glycine or desamino-glycine;
$X_6$ is glutamic acid, serine or threonine;
$X_7$ is threonine, histidine, arginine or lysine;
$X_8$ is asparagine, serine, threonine or glycine;
$X_9$ is serine or threonine;
$X_{10}$ is aspartic acid, glutamic acid, homocysteic acid or cysteic acid
$X_{11}$ and $X_{12}$ are independently selected from the group consisting of Tyr, phenylalanine and 4-hydroxymethyl Phe;
$X_{13}$ is selected from the group consisting of $FVNQX_{50}$ (SEQ ID NO: 1119), $VNQX_{50}$ (SEQ ID NO: 1120), $NQX_{50}$, $QX_{50}$, and $X_{50}$, wherein $X_{50}$ is histidine, serine or threonine, further wherein the first amino acid of $X_{13}$ is an O-amino acid linked to the dipeptide

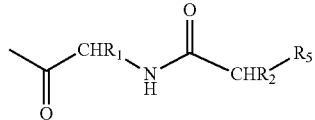

via an ester bond,
$R_1$ and $R_2$ are independently selected from the group consisting of H, $C_1$-$C_4$ alkyl, $(C_1$-$C_4$ alkyl)OH, $(C_1$-$C_4$ alkyl)SH, $(C_2$-$C_3$ alkyl)$SCH_3$, $(C_1$-$C_4$ alkyl)$CONH_2$, $(C_1$-$C_4$ alkyl)COOH, $(C_1$-$C_4$ alkyl)$NH_2$, $(C_1$-$C_4$ alkyl) $NHC(NH_2^+)NH_2$, $(C_4$-$C_6)$cycloalkyl, $(C_0$-$C_4$ alkyl)$(C_6$-$C_{10}$ aryl)$R_9$, and $CH_2(C_5$-$C_9$ heteroaryl); and
$R_5$ is OH or $NH_2$; and
$R_9$ is $C_1$-$C_4$ alkyl, $NH_2$ or OH.

9. The method of claim 8 wherein
$R_1$ is selected from the group consisting of $CH_2(CH_3)_2$, $(C_4$-$C_5)$cycloalkyl, $CH_2(C_6$ aryl), and $CH_2(C_5$-$C_6$ heteroaryl);
$R_2$ is selected from the group consisting of H, $(C_1$-$C_4$ alkyl)$NH_2$, $(C_4$-$C_5)$cycloalkyl, $CH_2(C_6$ aryl) and $CH_2$ $(C_5$-$C_6$ heteroaryl); and
$R_5$ is OH.

10. The method of claim 9 wherein
the A chain comprises the sequence of GIVEQCCTSICS-LYQLENYCN (SEQ ID NO: 613);
the B chain comprises the sequence $X_{13}$VNQHLCGSHLVEALYLVCGERGFFYTPKT (SEQ ID NO: 614), wherein $X_{13}$ is HO-Phe linked to the dipeptide

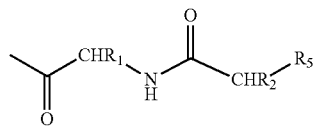

via and ester bond;
$R_1$ is $CH_2CH(CH_3)_2$; and
$R_2$ comprises ($C_1$-$C_4$ alkyl)$NH_2$.

11. The method of claim 10 wherein $R_2$ further comprises a C8 to C20 fatty acid linked to said amino group.

12. The method of claim 11 wherein one or both of the amino acids of the structure

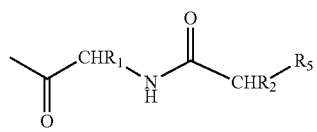

are in the D-sterioisomer conformation.

* * * * *